United States Patent
Hinkle et al.

(10) Patent No.: US 10,640,770 B2
(45) Date of Patent: May 5, 2020

(54) HEPATITIS D VIRUS (HDV) IRNA COMPOSITIONS AND METHODS OF USE THEREOF

(71) Applicant: Alnylam Pharmaceuticals, Inc., Cambridge, MA (US)

(72) Inventors: Gregory Hinkle, Cambridge, MA (US); Laura Sepp-Lorenzino, Jenkintown, PA (US); Vasant Jadhav, Sharon, MA (US); Martin Maier, Belmont, MA (US); Muthiah Manoharan, Weston, MA (US); Stuart Milstein, Arlington, MA (US); Svetlana Shulga Morskaya, Sudbury, MA (US); Kallanthottathil G. Rajeev, Wayland, MA (US); Huilei Xu, Boston, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 15/591,558

(22) Filed: May 10, 2017

(65) Prior Publication Data

US 2017/0349901 A1    Dec. 7, 2017

Related U.S. Application Data

(63) Continuation of application No. PCT/US2015/059958, filed on Nov. 10, 2015.

(60) Provisional application No. 62/137,464, filed on Mar. 24, 2015, provisional application No. 62/077,799, filed on Nov. 10, 2014, provisional application No. 62/077,672, filed on Nov. 10, 2014.

(51) Int. Cl.
| C12N 15/113 | (2010.01) |
| A61K 31/713 | (2006.01) |
| A61K 45/06  | (2006.01) |

(52) U.S. Cl.
CPC ........ *C12N 15/1131* (2013.01); *A61K 31/713* (2013.01); *A61K 45/06* (2013.01); *C12N 2310/14* (2013.01); *C12N 2310/315* (2013.01); *C12N 2310/321* (2013.01); *C12N 2310/322* (2013.01); *C12N 2310/335* (2013.01); *C12N 2310/3515* (2013.01)

(58) Field of Classification Search
None
See application file for complete search history.

(56) References Cited

U.S. PATENT DOCUMENTS

| 8,618,277 B2 | 12/2013 | Beigelman et al. |
| 8,648,185 B2 | 2/2014 | McSwigen et al. |
| 8,809,293 B2 | 8/2014 | Chin et al. |
| 9,029,341 B2 | 5/2015 | Bartz et al. |
| 9,464,290 B2 | 10/2016 | Bartz et al. |
| 9,879,262 B2 | 1/2018 | Bartz et al. |
| 2003/0206887 A1 | 11/2003 | Morrissey et al. |
| 2007/0031844 A1* | 2/2007 | Khvorova ............ A61K 31/713 435/6.11 |
| 2010/0145038 A1 | 6/2010 | McSwiggen et al. |
| 2015/0374844 A1* | 12/2015 | Degrado ................ C07K 14/00 514/21.3 |
| 2017/0349901 A1 | 12/2017 | Hinkle et al. |
| 2018/0008724 A1* | 1/2018 | Rajeev ................. C12N 15/113 |
| 2018/0037886 A1* | 2/2018 | Bettencourt .......... A61K 31/713 |

FOREIGN PATENT DOCUMENTS

| CN | 101314047 A | 12/2008 |
| CN | 101603042 A | 12/2009 |
| CN | 103014045 A | 4/2013 |
| CN | 103275971 A | 9/2013 |
| WO | WO-1998/028004 A1 | 7/1998 |
| WO | WO-2005/014806 A2 | 2/2005 |
| WO | WO-2006/033756 A2 | 3/2006 |
| WO | WO-2006/069064 A2 | 6/2006 |
| WO | WO-2008/103276 A2 | 8/2008 |
| WO | WO-2010/080724 A1 | 7/2010 |
| WO | WO-2012/024170 A2 | 2/2012 |
| WO | WO-2013074974 A2 * | 5/2013 | ........... C12N 15/113 |
| WO | WO-2013155204 A2 * | 10/2013 | ........... A61K 31/713 |

OTHER PUBLICATIONS

U.S. Appl. No. 13/817,152 U.S. Pat. No. 9,029,341, filed Feb. 15, 2013 May 12, 2015, US 20130150433, Granted.
U.S. Appl. No. 14/682,618 U.S. Pat. No. 9,464,290, filed Apr. 9, 2015 Oct. 11, 2016, US 20160076034, Granted.
U.S. Appl. No. 15/251,155 U.S. Pat. No. 9,879,262, filed Aug. 30, 2016 Jan. 30, 2018, US 20160369279, Granted.
U.S. Appl. No. 15/591,532, filed May 10, 2017, US 20170349900, Published.
Chang et al., "Susceptibility of Human Hepatitis Delta Virus RNAs to small Interfering RNA Action", Journal of Virology., vol. 77, No. 17, Sep. 1, 2003, pp. 9728-9731.

(Continued)

*Primary Examiner* — Sean McGarry
(74) *Attorney, Agent, or Firm* — McCarter & English, LLP; Maria Laccotripe Zacharakis; Deborah L. Nagle

(57) ABSTRACT

The present invention relates to RNAi agents, e.g., double-stranded RNAi agents, targeting the hepatitis D virus (HDV) genome, and methods of using such RNAi agents to inhibit expression of one or more HBV genes and methods of treating subjects having an HDV infection and/or HDV-associated disorder.

24 Claims, No Drawings

Specification includes a Sequence Listing.

(56) References Cited

OTHER PUBLICATIONS

Singh et al., "Design of potential siRNA molecules for hepatities delta virus gene silencing", Bioinformation, Jan. 1, 2012, pp. 749-757.
International Search Report and Written Opinion from PCT/US2015/059958, dated Feb. 10, 2016.
Chen et al., "RNAI for treating Hepatitis B Viral Infection", Pharmaceutical Research, 2008 vol. 25, No. I, pp. 72-86.
Liang, "Hepatitis B: the virus and disease", Hepatology. May 2009;49(5 Suppl):S13-21.
Di Bisceglie, "Hepatitis B and hepatocellular carcinoma." Hepatology. May 2009;49(5 Suppl):S56-60.
Yu, et al. "The Role of Antiviral Therapy for HBV-Related Hepatocellular Carcinoma", International Journal of Hepatology (2011), Article ID 416459.
International Search Report and Written Opinion from PCT/US2015/059916, dated May 4, 2016.
"RNAi Roundtable: ALN-HBV in Development for the treatment of Hepatitis B Virus (HBV) Infection", Jul. 29, 2014. http://www.alnylam.com/web/assets/Roundtable_ALN-HBV_072914.pdf.
"Poster Session 4: Hepatitis B Therapy", Hepatology, vo. 60, Oct. 1, 2014, pp. 1088A-1128A.

\* cited by examiner

HEPATITIS D VIRUS (HDV) IRNA COMPOSITIONS AND METHODS OF USE THEREOF

RELATED APPLICATIONS

This application is a 35 § U.S.C. 111(a) continuation application which claims the benefit of priority to PCT/US2015/059958, filed on Nov. 10, 2015, which claims priority to U.S. Provisional Application 62/077,672, filed on Nov. 10, 2014. The entire contents of each of the foregoing patent applications are incorporated herein by reference.

This application also claims priority to U.S. Provisional Application 62/077,799, filed on Nov. 10, 2014 and U.S. Provisional Application 62/137,464, filed on Mar. 24, 2015. The entire contents of each of the foregoing patent applications are incorporated herein by reference.

This application is related to International Patent Application, PCT/US2015/059916, entitled "Hepatitis B Viris (HBV) iRNA Compositions and Methods of Use Thereof," filed on Nov. 10, 2015, the entire contents of which are incorporated herein by reference.

SEQUENCE LISTING

The instant application contains a Sequence Listing which has been submitted electronically in ASCII format and is hereby incorporated by reference in its entirety. Said ASCII copy, created on Apr. 19, 2017, is named 121301_02802_SL.txt and is 774,825 bytes in size.

BACKGROUND OF THE INVENTION

Hepatitis D virus or hepatitis delta virus (HDV) is a human pathogen. Indeed HDV infection is highly endemic to several African countries, the Amazonian region, and the Middle East, while its prevalence is low in industrialized countries, except in the Mediterranean. However, the virus is defective and depends on obligatory helper functions provided by the hepatitis B virus (HBV) for transmission; indeed, HDV requires a simultaneous infection with HBV (co-infection) or superimposition on a pre-existing HBV infection (superinfection) to become infectious and thrive. In particular, HDV requires the HBV viral envelope containing the surface antigen of hepatitis B.

HDV is unique in human virology; it has a circular RNA genome of about 1,700 bases (see, e.g., Genbank Accession No. M21012.1 (GI:329989)) and is therefore the smallest infectious agent in man, and is similar to viroids and satellite RNAs of plants. HDV replicates by a rolling circle mechanism unknown to animal cells, possesses a self-cleaving ribozyme and is transcribed by host RNA polymerases that normally accept only DNA templates (Ciancio and Rizzetto, *Nat. Rev.* 11:68-71, 2014).

HDV is a circular, single stranded RNA virus that ranges from 1,672 (strain dFr45, Genbank accession number AX741144) to 1,697 nucleotides (dFr47, GenBank accession number AX741149). A unique open reading frame encodes the small and large hepatitis delta (sHD and lHD, respectively) antigens by way of an editing step in the hepatocyte nucleus.

The genetic diversity of HDV is related to the geographic origin of the isolates and there are at least eight genotypes that are referred to as HDV-1 through HDV-8. Apart from HDV-1, which is ubiquitous, HDV-2 (previously labeled HDV-IIa) is found in Japan, Taiwan, and Yakoutia, Russia; HDV-4 (previously labeled HDV-IIb) in Taiwan and Japan; HDV-3 which causes epidemics of severe and fulminant hepatitis in the Amazonian region (9); and HDV-5, HDV-6, HDV-7, and HDV-8 in Africa (LeGal et al., *Emerg. Infect. Dis.* 12:1447-1450, 2006).

Worldwide more than 400 million people are chronically infected with HBV. Furthermore, at the end of the 1980s, at least 5% of hepatitis B surface antigen (HBsAg) carriers throughout the globe (~15 million individuals) were estimated to also be infected with HDV. Subjects infected with HBV are at increased risk of developing serious liver disease, such as chronic hepatitis, cirrhosis, liver failure and hepatocellular carcinoma (HCC) resulting in an estimated 600,000 deaths each year. HDV infection in such subjects (either co-infection or superinfection) can lead to severe acute and chronic forms of liver disease in association with HBV. In fact, both superinfection and coinfection with HDV results in more severe complications compared to infection with HBV alone. These complications include resistance to treatment with standard therapies and a greater likelihood of experiencing liver failure in acute infections and a rapid progression to liver cirrhosis, with an increased chance of developing liver cancer in chronic infections. In combination with hepatitis B virus, hepatitis D has the highest fatality rate of all the hepatitis infections, at 20%.

Accordingly, there is a need in the art for alternative therapies and combination therapies for subjects infected with HDV and/or having an HDV-associated disease.

SUMMARY OF THE INVENTION

The present invention provides iRNA compositions which effect the RNA-induced silencing complex (RISC)-mediated cleavage of RNA transcripts of a Hepatitis D virus (HDV) gene. The HDV gene may be within a cell, e.g., a cell within a subject, such as a human.

The present invention also provides methods and therapies for treating a subject having a disorder that would benefit from inhibiting or reducing the expression of an HDV gene, e.g., an HDV infection and/or an HDV-associated disease, such as hepatitis B virus infection, chronic hepatitis B infection (CHB), chronic Hepatitis D infection (CHD), cirrhosis, liver failure, and hepatocellular carcinoma (HCC), using iRNA compositions which effect the RNA-induced silencing complex (RISC)-mediated cleavage of RNA transcripts of an HDV gene for inhibiting the expression of an HDV gene. As HDV depends on obligatory helper functions provided by HBV for transmission, the methods for treatment of HDV can comprise agents and therapies useful for treating an HBV infection and/or an HBV-associated disorder, such as hepatitis D virus infection, chronic hepatitis D infection (CHD), chronic Hepatitis B infection (CHB), cirrhosis, liver failure, and hepatocellular carcinoma (HCC).

In certain embodiments, the RNAi agents of the invention have been designed to target regions in the HDV genomes that are conserved across at least two, preferably 3, or more of the 8 serotypes of HDV (HDV-1, HDV-2, HDV-3, HDV-4, HDV-5, HDV-6, HDV-7, and HDV-8).

Accordingly, in one aspect, the present invention provides double stranded RNAi agents for inhibiting expression of hepatitis D virus (HDV) in a cell. The double stranded RNAi agents include a sense strand and an antisense strand forming a double-stranded region, wherein the sense strand comprises at least 15 contiguous nucleotides differing by no more than 3 nucleotides from the nucleotide sequence of SEQ ID NO:29, and the antisense strand comprises at least 15 contiguous nucleotides differing by no more than 3 nucleotides from the nucleotide sequence of SEQ ID NO:30, wherein substantially all of the nucleotides of the sense strand and substantially all of the nucleotides of the antisense strand are modified nucleotides, wherein the sense strand is conjugated to a ligand attached at the 3'-terminus, and wherein the ligand is one or more GalNAc derivatives attached through a bivalent or trivalent branched linker.

In another aspect, the present invention provides double stranded RNAi agents for inhibiting expression of hepatitis D virus (HDV) in a cell. The double stranded RNAi agents include a sense strand and an antisense strand forming a double-stranded region, wherein the sense strand comprises at least 15 contiguous nucleotides differing by no more than 3 nucleotides from the nucleotide sequence of SEQ ID NO:31, and the antisense strand comprises at least 15 contiguous nucleotides differing by no more than 3 nucleotides from the nucleotide sequence of SEQ ID NO:32, wherein substantially all of the nucleotides of the sense strand and substantially all of the nucleotides of the antisense strand are modified nucleotides, wherein the sense strand is conjugated to a ligand attached at the 3'-terminus, and wherein the ligand is one or more GalNAc derivatives attached through a bivalent or trivalent branched linker.

In one aspect, the present invention provides double stranded RNAi agents for inhibiting expression of hepatitis D virus (HDV) in a cell. The double stranded RNAi agents include a sense strand and an antisense strand forming a double-stranded region, wherein the sense strand comprises at least 15 contiguous nucleotides differing by no more than 3 nucleotides from the nucleotide sequence of SEQ ID NO:33, and the antisense strand comprises at least 15 contiguous nucleotides differing by no more than 3 nucleotides from the nucleotide sequence of SEQ ID NO:34, wherein substantially all of the nucleotides of the sense strand and substantially all of the nucleotides of the antisense strand are modified nucleotides, wherein the sense strand is conjugated to a ligand attached at the 3'-terminus, and wherein the ligand is one or more GalNAc derivatives attached through a bivalent or trivalent branched linker.

In one aspect, the present invention provides double stranded RNAi agents for inhibiting expression of hepatitis D virus (HDV) in a cell. The double stranded RNAi agents include a sense strand and an antisense strand forming a double-stranded region, wherein the sense strand comprises at least 15 contiguous nucleotides differing by no more than 3 nucleotides from the nucleotide sequence of SEQ ID NO:35, and the antisense strand comprises at least 15 contiguous nucleotides differing by no more than 3 nucleotides from the nucleotide sequence of SEQ ID NO:36, wherein substantially all of the nucleotides of the sense strand and substantially all of the nucleotides of the antisense strand are modified nucleotides, wherein the sense strand is conjugated to a ligand attached at the 3'-terminus, and wherein the ligand is one or more GalNAc derivatives attached through a bivalent or trivalent branched linker.

In another aspect, the present invention provides double stranded RNAi agents for inhibiting expression of hepatitis D virus (HDV) in a cell. The double stranded RNAi agents include a sense strand and an antisense strand forming a double-stranded region, wherein the sense strand comprises at least 15 contiguous nucleotides differing by no more than 3 nucleotides from the nucleotide sequence of SEQ ID NO:37, and the antisense strand comprises at least 15 contiguous nucleotides differing by no more than 3 nucleotides from the nucleotide sequence of SEQ ID NO:38, wherein substantially all of the nucleotides of the sense strand and substantially all of the nucleotides of the antisense strand are modified nucleotides, wherein the sense strand is conjugated to a ligand attached at the 3'-terminus, and wherein the ligand is one or more GalNAc derivatives attached through a bivalent or trivalent branched linker.

In yet another aspect, the present invention provides double stranded RNAi agents for inhibiting expression of hepatitis D virus (HDV) in a cell. The double stranded RNAi agents include a sense strand and an antisense strand forming a double-stranded region, wherein the sense strand comprises at least 15 contiguous nucleotides differing by no more than 3 nucleotides from the nucleotide sequence of SEQ ID NO:39, and the antisense strand comprises at least 15 contiguous nucleotides differing by no more than 3 nucleotides from the nucleotide sequence of SEQ ID NO:40, wherein substantially all of the nucleotides of the sense strand and substantially all of the nucleotides of the antisense strand are modified nucleotides, wherein the sense strand is conjugated to a ligand attached at the 3'-terminus, and wherein the ligand is one or more GalNAc derivatives attached through a bivalent or trivalent branched linker.

In one aspect, the present invention provides double stranded RNAi agents for inhibiting expression of hepatitis D virus (HDV) in a cell. The double stranded RNAi agents include a sense strand and an antisense strand forming a double-stranded region, wherein the sense strand comprises at least 15 contiguous nucleotides differing by no more than 3 nucleotides from the nucleotide sequence of SEQ ID NO:41, and the antisense strand comprises at least 15 contiguous nucleotides differing by no more than 3 nucleotides from the nucleotide sequence of SEQ ID NO:42, wherein substantially all of the nucleotides of the sense strand and substantially all of the nucleotides of the antisense strand are modified nucleotides, wherein the sense strand is conjugated to a ligand attached at the 3'-terminus, and wherein the ligand is one or more GalNAc derivatives attached through a bivalent or trivalent branched linker.

In another aspect, the present invention provides double stranded RNAi agents for inhibiting expression of hepatitis D virus (HDV) in a cell. The double stranded RNAi agents include a sense strand and an antisense strand forming a double-stranded region, wherein the sense strand comprises at least 15 contiguous nucleotides differing by no more than 3 nucleotides from the nucleotide sequence of SEQ ID NO:43, and the antisense strand comprises at least 15 contiguous nucleotides differing by no more than 3 nucleotides from the nucleotide sequence of SEQ ID NO:44, wherein substantially all of the nucleotides of the sense strand and substantially all of the nucleotides of the antisense strand are modified nucleotides, wherein the sense strand is conjugated to a ligand attached at the 3'-terminus, and wherein the ligand is one or more GalNAc derivatives attached through a bivalent or trivalent branched linker.

In one aspect, the present invention provides double stranded RNAi agents for inhibiting expression of hepatitis D virus (HDV) in a cell. The double stranded RNAi agents include a sense strand and an antisense strand forming a double-stranded region, wherein the sense strand comprises at least 15 contiguous nucleotides differing by no more than 3 nucleotides from the nucleotide sequence of SEQ ID NO:2551, and the antisense strand comprises at least 15 contiguous nucleotides differing by no more than 3 nucleotides from the nucleotide sequence of SEQ ID NO: 2552, wherein substantially all of the nucleotides of the sense strand and substantially all of the nucleotides of the antisense strand are modified nucleotides, wherein the sense strand is conjugated to a ligand attached at the 3'-terminus, and wherein the ligand is one or more GalNAc derivatives attached through a bivalent or trivalent branched linker. In certain embodiments, the sense strand of the double stranded RNAi agents comprises at least 15 contiguous nucleotides differing by no more than 3 nucleotides from nucleotides 1451-1484, nucleotides 1455-1480, nucleotides 1455-1474, or nucleotides 1417-1443 of the nucleotide sequence of SEQ ID NO:2551.

In one embodiment, the one or more of the 3 nucleotide differences in the nucleotide sequence of the antisense strand is a nucleotide mismatch in the antisense strand.

In another embodiment, the one or more of the 3 nucleotide differences in the nucleotide sequence of the antisense strand is a nucleotide mismatch in the sense strand.

In one embodiment, all of the nucleotides of the sense strand and all of the nucleotides of the antisense strand are modified nucleotides.

In one embodiment, the sense strand and the antisense strand comprise a region of complementarity which comprises at least 15 contiguous nucleotides differing by no more than 3 nucleotides from any one of the sequences listed in any one of Tables 11, 12, 31, and 32.

In some embodiments, the sense strand and the antisense strand comprise a region of complementarity which comprises at least 15 contiguous nucleotides differing by no more than 3 nucleotides from the nucleotide sequences of the sense strand and the antisense strand sequences of any one of duplexes AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, and AD-70275.1. In other embodiments, the sense strand and the antisense strand comprise a region of complementarity which comprises at least 15 contiguous nucleotides differing by no more than 3 nucleotides from the nucleotide sequences of the sense strand and the antisense strand sequences of any one of duplexes AD-70260.1, AD-70232.1, AD-70249.1, AD-70244.1, AD-70272.1, AD-70228.1, AD-70255.1, AD-70278.1, and AD-70295.1.

In one embodiment, the at least one of the modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic.

In one embodiment, the at least one strand comprises a 3' overhang of at least 1 nucleotide. In another embodiment, the at least one strand comprises a 3' overhang of at least 2 nucleotides.

In one embodiment, the double-stranded region is 15-30 nucleotide pairs in length. In another embodiment, the double-stranded region is 17-23 nucleotide pairs in length. In yet another embodiment, the double-stranded region is 17-25 nucleotide pairs in length. In one embodiment, the e double-stranded region is 23-27 nucleotide pairs in length. In another embodiment, the double-stranded region is 19-21 nucleotide pairs in length. In yet another embodiment, the double-stranded region is 21-23 nucleotide pairs in length.

In one embodiment, each strand has 15-30 nucleotides. In another embodiment, each strand has 19-30 nucleotides.

In one embodiment, the ligand is

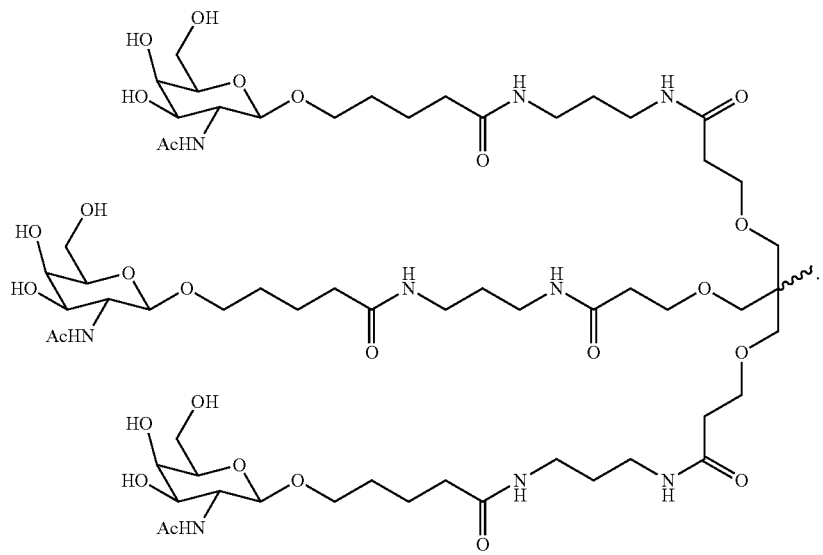 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one embodiment, the RNAi agent is conjugated to the ligand as shown in the following schematic In another embodiment, the antisense strand is selected from the group consisting of the antisense strand sequences

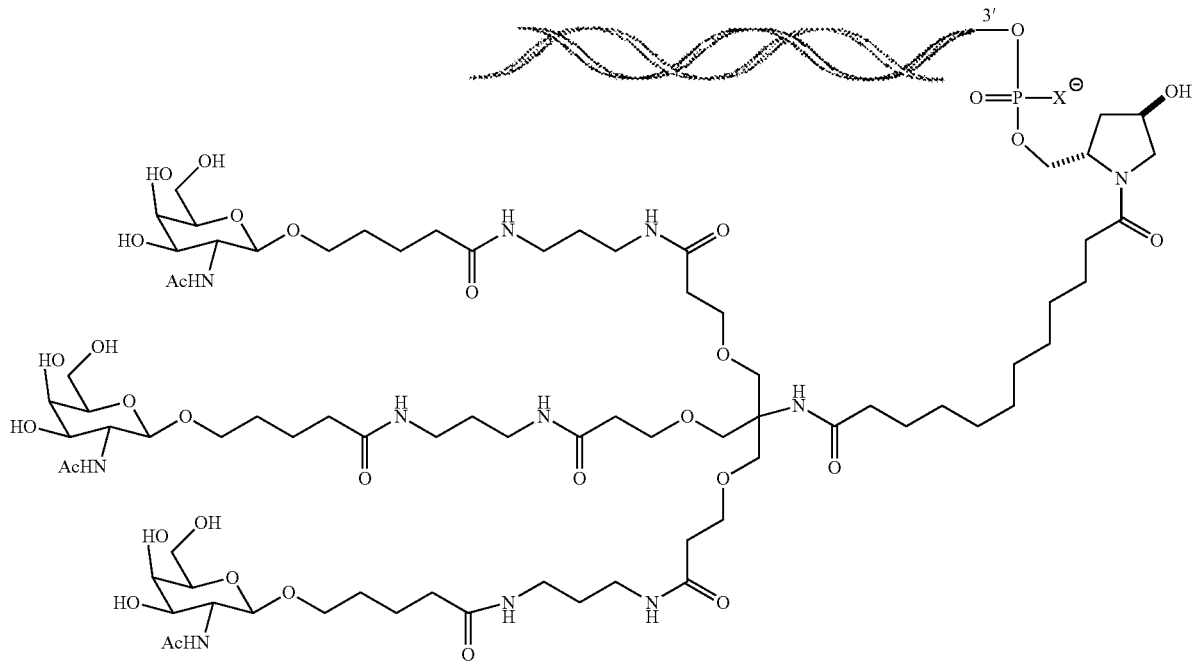

wherein X is O or S.

In one embodiment, the RNAi agent is selected from the group of RNAi agents listed in any one of Tables 11, 12, 31, and 32.

In one embodiment the agent is selected from the group consisting of AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, and AD-70275.1.

In one aspect, the present invention provides double stranded RNAi agents for inhibiting expression of hepatitis D virus (HDV) in a cell. The double stranded RNAi agents include a sense strand and an antisense strand forming a double-stranded region, wherein the sense strand comprises any one of the sense sequences from Tables 11, 12, 31, and 32, and the antisense strand comprises any one of the antisense sequences from Tables 11, 12, 31, and 32, wherein substantially all of the nucleotides of the sense strand and substantially all of the nucleotides of the antisense strand are modified nucleotides, wherein the sense strand is conjugated to a ligand attached at the 3'-terminus, and wherein the ligand is one or more GalNAc derivatives attached through a bivalent or trivalent branched linker.

In one embodiment, the sense strand is selected from the group consisting of the sense strand sequences of AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1.

of AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1.

The present invention also provides RNAi agents comprising sense and antisense nucleotide sequences which are at least 90%, 91%, 92%, 93%, 94%, 95%, 96%, 97%, 98%, or 99% identical over their entire length to the foregoing sense and antisense nucleotide sequences In one embodiment, all of the nucleotides of the sense strand and all of the nucleotides of the antisense strand comprise a modification.

In one embodiment, at least one of the modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic.

In one embodiment, the 5'-phosphate mimic is a 5'-vinyl phosphate (5'-VP).

In one embodiment, the ligand is

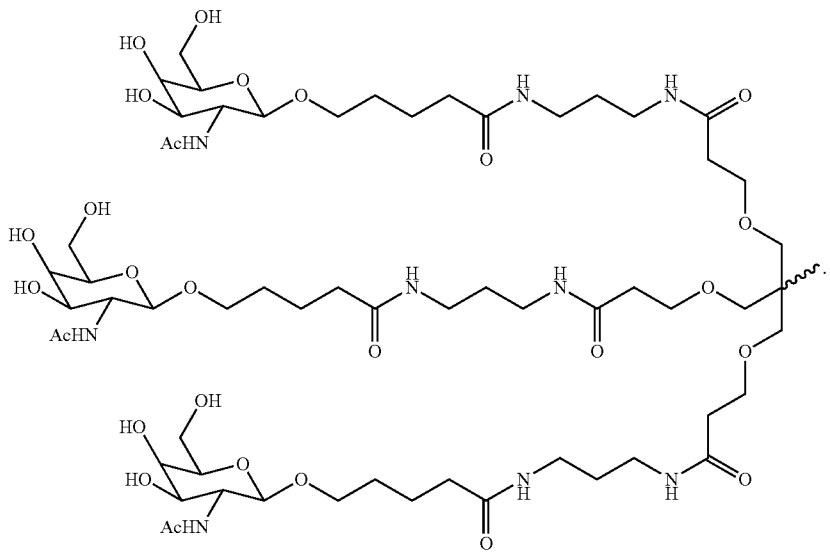 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one embodiment, the RNAi agent is conjugated to the ligand as shown in the following schematic

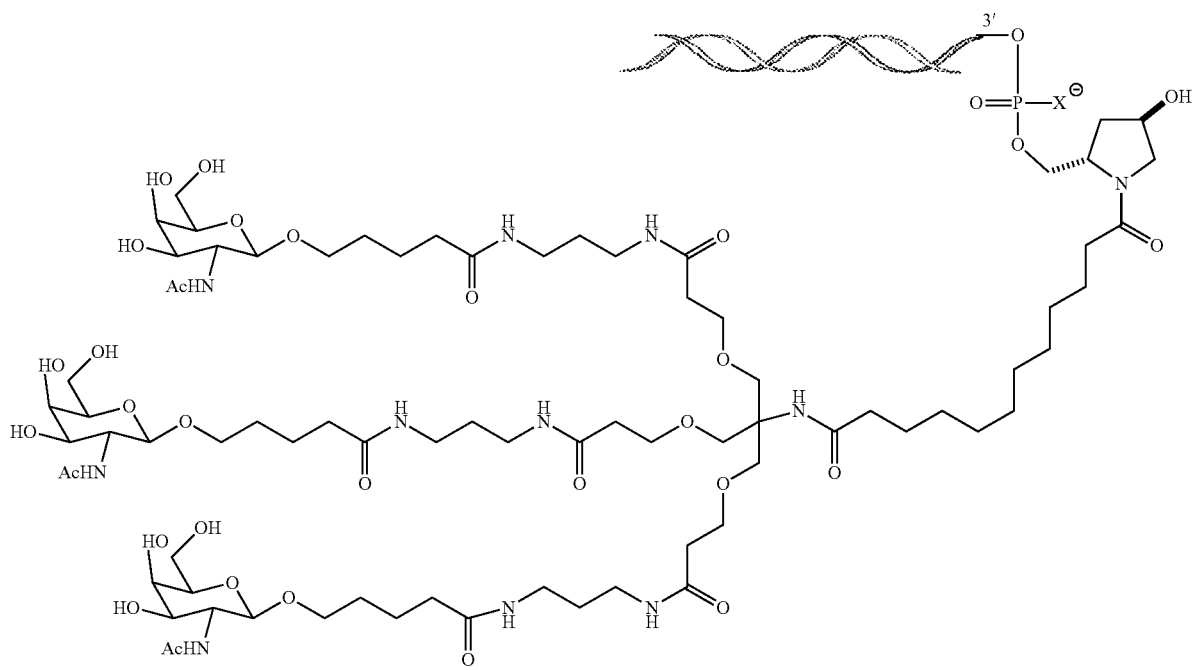

wherein X is O or S.

In one aspect, the present invention provides compositions comprising two or more double stranded RNAi agents for inhibiting expression of hepatitis D virus (HDV) in a cell, wherein each double stranded RNAi agent independently comprises a sense strand and an antisense strand forming a double-stranded region, wherein each of the sense strands independently comprises at least 15 contiguous nucleotides differing by no more than 3 nucleotides from the nucleotide sequence of SEQ ID NO:29, and each of the antisense strands independently comprises at least 15 contiguous nucleotides differing by no more than 3 nucleotides from the nucleotide sequence of SEQ ID NO:30, wherein substantially all of the nucleotides of each of the sense strands and substantially all of the nucleotides of each of the antisense strands are independently modified nucleotides, wherein each of the sense strands are independently conjugated to a ligand attached at the 3'-terminus, and wherein the ligand is one or more GalNAc derivatives attached through a bivalent or trivalent branched linker.

In another aspect, the present invention provides compositions comprising two or more double stranded RNAi agents for inhibiting expression of hepatitis D virus (HDV) in a cell, wherein each double stranded RNAi agent independently comprises a sense strand and an antisense strand forming a double-stranded region, wherein each of the sense strands independently comprises at least 15 contiguous nucleotides differing by no more than 3 nucleotides from the nucleotide sequence of SEQ ID NO:31, and each of the antisense strands independently comprises at least 15 contiguous nucleotides differing by no more than 3 nucleotides from the nucleotide sequence of SEQ ID NO:32, wherein substantially all of the nucleotides of each of the sense strands and substantially all of the nucleotides of each of the antisense strands are independently modified nucleotides, wherein each of the sense strands are independently conjugated to a ligand attached at the 3'-terminus, and wherein the ligand is one or more GalNAc derivatives attached through a bivalent or trivalent branched linker.

In another aspect, the present invention provides compositions comprising two or more double stranded RNAi agents for inhibiting expression of hepatitis D virus (HDV) in a cell, wherein each double stranded RNAi agent independently comprises a sense strand and an antisense strand forming a double-stranded region, wherein each of the sense strands independently comprises at least 15 contiguous nucleotides differing by no more than 3 nucleotides from the nucleotide sequence of SEQ ID NO:33, and each of the antisense strands independently comprises at least 15 contiguous nucleotides differing by no more than 3 nucleotides from the nucleotide sequence of SEQ ID NO:34, wherein substantially all of the nucleotides of each of the sense strands and substantially all of the nucleotides of each of the antisense strands are independently modified nucleotides, wherein each of the sense strands are independently conjugated to a ligand attached at the 3'-terminus, and wherein the ligand is one or more GalNAc derivatives attached through a bivalent or trivalent branched linker.

In yet another aspect, the present invention provides compositions comprising two or more double stranded RNAi agents for inhibiting expression of hepatitis D virus (HDV) in a cell, wherein each double stranded RNAi agent independently comprises a sense strand and an antisense strand forming a double-stranded region, wherein each of the sense strands independently comprises at least 15 contiguous nucleotides differing by no more than 3 nucleotides from the nucleotide sequence of SEQ ID NO:35, and each of the antisense strands independently comprises at least 15 contiguous nucleotides differing by no more than 3 nucleotides from the nucleotide sequence of SEQ ID NO:36, wherein substantially all of the nucleotides of each of the sense strands and substantially all of the nucleotides of each of the antisense strands are independently modified nucleotides, wherein each of the sense strands are independently conjugated to a ligand attached at the 3'-terminus, and wherein the ligand is one or more GalNAc derivatives attached through a bivalent or trivalent branched linker.

In one aspect, the present invention provides compositions comprising two or more double stranded RNAi agents for inhibiting expression of hepatitis D virus (HDV) in a cell, wherein each double stranded RNAi agent independently comprises a sense strand and an antisense strand forming a double-stranded region, wherein each of the sense strands independently comprises at least 15 contiguous nucleotides differing by no more than 3 nucleotides from the nucleotide sequence of SEQ ID NO:37, and each of the antisense strands independently comprises at least 15 contiguous nucleotides differing by no more than 3 nucleotides from the nucleotide sequence of SEQ ID NO:38, wherein substantially all of the nucleotides of each of the sense strands and substantially all of the nucleotides of each of the antisense strands are independently modified nucleotides, wherein each of the sense strands are independently conjugated to a ligand attached at the 3'-terminus, and wherein the ligand is one or more GalNAc derivatives attached through a bivalent or trivalent branched linker.

In another aspect, the present invention provides compositions comprising two or more double stranded RNAi agents for inhibiting expression of hepatitis D virus (HDV) in a cell, wherein each double stranded RNAi agent independently comprises a sense strand and an antisense strand forming a double-stranded region, wherein each of the sense strands independently comprises at least 15 contiguous nucleotides differing by no more than 3 nucleotides from the nucleotide sequence of SEQ ID NO:39, and each of the antisense strands independently comprises at least 15 contiguous nucleotides differing by no more than 3 nucleotides from the nucleotide sequence of SEQ ID NO:40, wherein substantially all of the nucleotides of each of the sense strands and substantially all of the nucleotides of each of the antisense strands are independently modified nucleotides, wherein each of the sense strands are independently conjugated to a ligand attached at the 3'-terminus, and wherein the ligand is one or more GalNAc derivatives attached through a bivalent or trivalent branched linker.

In another aspect, the present invention provides compositions comprising two or more double stranded RNAi agents for inhibiting expression of hepatitis D virus (HDV) in a cell, wherein each double stranded RNAi agent independently comprises a sense strand and an antisense strand forming a double-stranded region, wherein each of the sense strands independently comprises at least 15 contiguous nucleotides differing by no more than 3 nucleotides from the nucleotide sequence of SEQ ID NO:41, and each of the antisense strands independently comprises at least 15 contiguous nucleotides differing by no more than 3 nucleotides from the nucleotide sequence of SEQ ID NO:42, wherein substantially all of the nucleotides of each of the sense strands and substantially all of the nucleotides of each of the antisense strands are independently modified nucleotides, wherein each of the sense strands are independently conjugated to a ligand attached at the 3'-terminus, and wherein the ligand is one or more GalNAc derivatives attached through a bivalent or trivalent branched linker.

In one aspect, the present invention provides compositions comprising two or more double stranded RNAi agents for inhibiting expression of hepatitis D virus (HDV) in a cell, wherein each double stranded RNAi agent independently comprises a sense strand and an antisense strand forming a double-stranded region, wherein each of the sense strands independently comprises at least 15 contiguous nucleotides differing by no more than 3 nucleotides from the nucleotide sequence of SEQ ID NO:43, and each of the antisense strands independently comprises at least 15 contiguous nucleotides differing by no more than 3 nucleotides from the nucleotide sequence of SEQ ID NO:44, wherein substantially all of the nucleotides of each of the sense strands and substantially all of the nucleotides of each of the antisense strands are independently modified nucleotides, wherein each of the sense strands are independently conjugated to a ligand attached at the 3'-terminus, and wherein the ligand is one or more GalNAc derivatives attached through a bivalent or trivalent branched linker.

In another aspect, the present invention provides compositions comprising two or more double stranded RNAi agents for inhibiting expression of hepatitis D virus (HDV)

in a cell, wherein each double stranded RNAi agent independently comprises a sense strand and an antisense strand forming a double-stranded region, wherein each of the sense strands independently comprises at least 15 contiguous nucleotides differing by no more than 3 nucleotides from the nucleotide sequence of SEQ ID NO:2551, and each of the antisense strands independently comprises at least 15 contiguous nucleotides differing by no more than 3 nucleotides from the nucleotide sequence of SEQ ID NO:2552, wherein substantially all of the nucleotides of each of the sense strands and substantially all of the nucleotides of each of the antisense strands are independently modified nucleotides, wherein each of the sense strands are independently conjugated to a ligand attached at the 3'-terminus, and wherein the ligand is one or more GalNAc derivatives attached through a bivalent or trivalent branched linker.

In certain embodiments, the sense strand of one or both of the first and second double stranded RNAi agents comprises at least 15 contiguous nucleotides from nucleotides 1451-1484, nucleotides 1455-1480, nucleotides 1455-1474, or nucleotides 1417-1443 of the nucleotide sequence of SEQ ID NO:2551.

In one embodiment, the one or more of the 3 nucleotide differences in the nucleotide sequence of the antisense strand is a nucleotide mismatch in the antisense strand. In another embodiment, the one or more of the 3 nucleotide differences in the nucleotide sequence of the antisense strand is a nucleotide mismatch in the sense strand.

In one embodiment, all of the nucleotides of the sense strand and all of the nucleotides of the antisense strand are modified nucleotides.

In one embodiment, the sense strand and the antisense strand comprise a region of complementarity which comprises at least 15 contiguous nucleotides differing by no more than 3 nucleotides from any one of the sequences listed in any one of Tables 11, 12, 31, and 32.

In some embodiments, the sense strand and the antisense strand comprise a region of complementarity which comprises at least 15 contiguous nucleotides differing by no more than 3 nucleotides from the nucleotide sequences of the sense strand and the antisense strand sequences of any one of duplexes AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1.

In other embodiments, the sense strand and the antisense strand comprise a region of complementarity which comprises at least 15 contiguous nucleotides differing by no more than 3 nucleotides from the nucleotide sequences of the sense strand and antisense strand sequences of any one of duplexes AD-70260.1, AD-70232.1, AD-70249.1, AD-70244.1, AD-70272.1, AD-70228.1, AD-70255.1, AD-70278.1, or AD-70295.1.

In one embodiment, the at least one of the modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic.

In another aspect, the present invention provides compositions for inhibiting expression of hepatitis D virus (HDV) in a cell, the composition comprising (a) a first double-stranded RNAi agent comprising a first sense strand and a first antisense strand forming a double-stranded region, wherein substantially all of the nucleotides of the first sense strand and substantially all of the nucleotides of the first antisense strand are modified nucleotides, wherein the first sense strand is conjugated to a ligand attached at the 3'-terminus, and wherein the ligand is one or more GalNAc derivatives attached through a bivalent or trivalent branched linker; and (b) a second double-stranded RNAi agent comprising a second sense strand and a second antisense strand forming a double-stranded region, wherein substantially all of the nucleotides of the second sense strand and substantially all of the nucleotides of the second antisense strand are modified nucleotides, wherein the second sense strand is conjugated to a ligand attached at the 3'-terminus, and wherein the ligand is one or more GalNAc derivatives attached through a bivalent or trivalent branched linker; wherein the first and second sense strands each independently comprise a sequence selected from the group consisting of any one of the sense sequences from Tables 11, 12, 31, and 32 (or a nucleotide sequence which is at least 90%, 91%, 92%, 93%, 94%, 95%, 96%, 97%, 98%, or 99% identical over its entire length to the foregoing nucleotide sequences), and wherein the first and second antisense strands each independently comprise a sequence selected from the group consisting of any one of the antisense sequences from Tables 11, 12, 31, and 32 (or a nucleotide sequence which is at least 90%, 91%, 92%, 93%, 94%, 95%, 96%, 97%, 98%, or 99% identical over its entire length to the foregoing nucleotide sequences).

In one embodiment, the first and second sense strands each independently comprise a sequence selected from the group consisting of any one of the sense sequences from AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1 (or a nucleotide sequence which is at least 90%, 91%, 92%, 93%, 94%, 95%, 96%, 97%, 98%, or 99% identical over its entire length to the foregoing nucleotide sequences).

In another embodiment, the first and second antisense strands each independently comprise a sequence selected from the group consisting of any one of the antisense sequences from AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1 (or a nucleotide sequence which is at least 90%, 91%, 92%, 93%, 94%, 95%, 96%, 97%, 98%, or 99% identical over its entire length to the foregoing nucleotide sequences).

In one embodiment, the first and second sense strand and/or all of the nucleotides of the first and second antisense strand comprise a modification.

In one embodiment, the at least one of the modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic.

In one embodiment, the first and second RNAi agent are selected from the group consisting of any one of the sequences provided in Tables 11, 12, 31, and 32.

In one embodiment, the first and second RNAi agent are selected from the group consisting of any one of AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1.

In one embodiment, the first and second RNAi agent are selected from the group consisting of any one of AD-70260.1, AD-70232.1, AD-70249.1, AD-70244.1, AD-70272.1, AD-70228.1, AD-70255.1, AD-70278.1, or AD-70295.1.

In one aspect, the present invention provides a double stranded RNAi agent comprising any one of the RNAi agents listed in any one of Tables 11, 12, 31, 32, In one embodiment the agent is selected from the group consisting of AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1. In another embodiment, the agent is selected from the group consisting of AD-70260.1, AD-70232.1, AD-70249.1, AD-70244.1, AD-70272.1, AD-70228.1, AD-70255.1, AD-70278.1, or AD-70295.1.

The present invention also provides vectors and cells comprising the double stranded RNAi agent of the invention.

In another aspect, the present invention provides pharmaceutical compositions comprising the double stranded RNAi agents of the invention, or the compositions of the invention, or the vectors of the invention.

In one embodiment, the double stranded RNAi agent is administered in an unbuffered solution. In one embodiment, the unbuffered solution is saline or water.

In another embodiment, the double stranded RNAi agent is administered with a buffer solution. In one embodiment, the buffer solution comprises acetate, citrate, prolamine, carbonate, or phosphate or any combination thereof. In another embodiment, the buffer solution is phosphate buffered saline (PBS).

In one aspect, the present invention provides methods of inhibiting Hepatitis D virus (HDV) gene expression in a cell. The methods include contacting the cell with the double stranded RNAi agent of the invention, or the composition of the invention, or the vector of the invention, or the pharmaceutical composition of the invention; and maintaining the cell produced for a time sufficient to obtain degradation of the mRNA transcript of an HDV gene, thereby inhibiting expression of the HDV gene in the cell.

In one aspect, the present invention provides methods of inhibiting replication of a Hepatitis D virus (HDV) in a cell. The methods include contacting the cell with the double stranded RNAi agent of the invention, or the composition of the invention, or the vector of the invention, or the pharmaceutical composition of the invention; and maintaining the cell produced for a time sufficient to obtain degradation of the mRNA transcript of an HDV gene, thereby inhibiting replication of the HDV in the cell.

In one embodiment, the cell is within a subject. In one embodiment, the subject is a human.

In one embodiment, the subject suffers from an HDV-associated disease.

In one embodiment, HDV gene expression is inhibited by at least about 30%, about 40%, about 50%, about 60%, about 70%, about 80%, about 90%, about 95%, about 98% or about 100%.

In one embodiment, replication of HDV in the cell is inhibited by at least about 30%, about 40%, about 50%, about 60%, about 70%, about 80%, about 90%, about 95%, about 98% or about 100%.

In one aspect, the present invention provides methods of reducing the level of Hepatitis D virus (HDV) DNA in a subject infected with HDV. The methods include administering to the subject a therapeutically effective amount of the double stranded RNAi agent of the invention, or the composition of the invention, or the vector of the invention, or the pharmaceutical composition of the invention, thereby reducing the level of HDV DNA in the subject.

In another aspect, the present invention provides methods of reducing the level of a Hepatitis D virus (HDV) antigen in a subject infected with HDV. The methods include administering to the subject a therapeutically effective amount of the double stranded RNAi agent of the invention, or the composition of the invention, or the vector of the invention, or the pharmaceutical composition of the invention, thereby reducing the level of the HDV antigen in the subject. The level of the large HDV antigen may be reduced, the level of the small HDV antigen may be reduced, or the level of both the large and the small HDV antigens may be reduced.

In another aspect, the present invention provides methods of reducing the viral load of Hepatitis D virus (HDV) in a subject infected with HDV. The methods include administering to the subject a therapeutically effective amount of the double stranded RNAi agent of the invention, or the composition of the invention, or the vector of the invention, or the pharmaceutical composition of the invention, thereby reducing the viral load of HDV in the subject.

In one aspect, the present invention provides methods of treating a subject having a Hepatitis D virus (HDV) infection. The methods include administering to the subject a therapeutically effective amount of the double stranded RNAi agent of the invention, or the composition of the invention, or the vector of the invention, or the pharmaceutical composition of the invention, thereby treating the subject.

In another aspect, the present invention provides methods of treating a subject having a Hepatitis D virus (HDV)-associated disorder. The methods include administering to the subject a therapeutically effective amount of the double stranded RNAi agent of the invention, or the composition of the invention, or the vector of the invention, or the pharmaceutical composition of the invention, thereby treating the subject.

In one embodiment, the HDV-associated disorder is selected from the group consisting of hepatitis B virus infection, acute hepatits B, acute hepatitis D; acute fulminant hepatitis D; chronic hepatitis D; liver fibrosis; end-stage liver disease; hepatocellular carcinoma.

In one aspect, the present invention provides methods of treating a subject having a Hepatitis D virus (HDV) infection. The methods include administering to the subject a therapeutically effective amount of a double stranded RNAi agent, wherein the double stranded RNAi agent comprises a sense strand and an antisense strand forming a double-stranded region, wherein the sense strand comprises any one sense sequences from any one of Tables 11, 12, 31, and 32 (or a nucleotide sequence which is at least 90%, 91%, 92%, 93%, 94%, 95%, 96%, 97%, 98%, or 99% identical over its entire length to the foregoing nucleotide sequence), and the antisense strand comprises any one of the antisense sequences from any one of Tables 11, 12, 31, and 32 (or a nucleotide sequence which is at least 90%, 91%, 92%, 93%, 94%, 95%, 96%, 97%, 98%, or 99% identical over its entire length to the foregoing nucleotide sequence), wherein substantially all of the nucleotides of the sense strand and substantially all of the nucleotides of the antisense strand are modified nucleotides, wherein the sense strand is conjugated to a ligand attached at the 3'-terminus, and wherein the ligand is one or more GalNAc derivatives attached through a bivalent or trivalent branched linker, thereby treating the subject.

In one embodiment, the sense strand comprises a sequence selected from the group consisting of any one of the sense sequences from AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1 (or a nucleotide sequence which is at least 90%, 91%, 92%, 93%, 94%, 95%, 96%, 97%, 98%, or 99% identical over its entire length to the foregoing nucleotide sequences).

In another embodiment, the antisense strand comprises a sequence selected from the group consisting of any one of the antisense sequences from AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1 (or a nucleotide sequence which is at least 90%, 91%, 92%, 93%, 94%, 95%, 96%, 97%, 98%, or 99% identical over its entire length to the foregoing nucleotide sequences).

In one embodiment, all of the nucleotides of the sense strand and all of the nucleotides of the antisense strand comprise a modification.

In one embodiment, the at least one of the modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic.

In one embodiment, the 5'-phosphate mimic is a 5'-vinyl phosphate (5'-VP).

In one embodiment, the ligand is

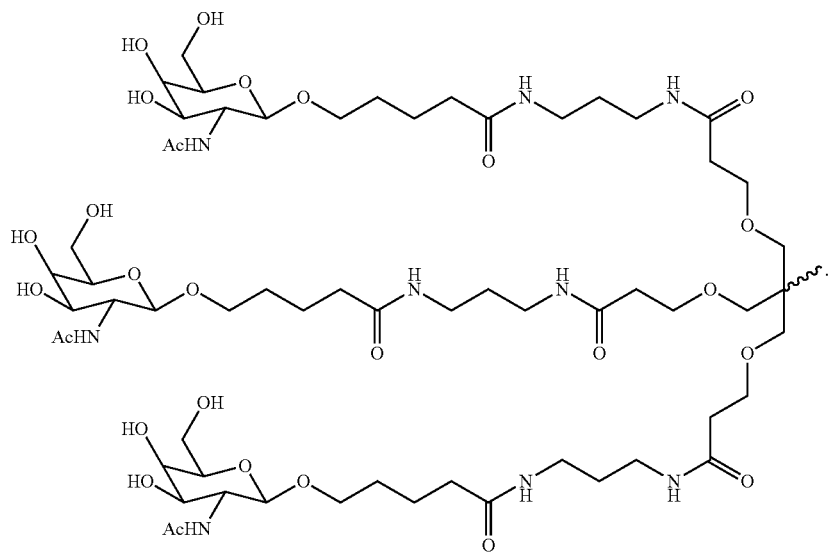 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one embodiment, the RNAi agent is conjugated to the ligand as shown in the following schematic

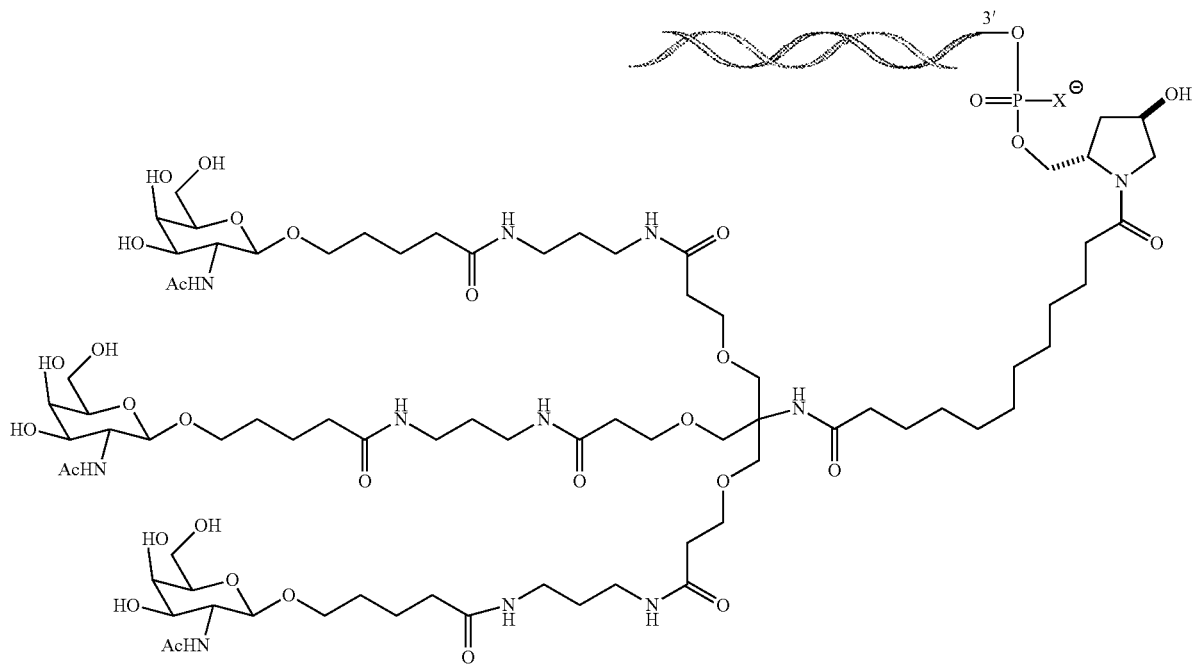

wherein X is O or S.

In one embodiment, the HDV-associated disorder is selected from the group consisting of hepatitis B virus infection, acute hepatits B, acute hepatitis D; acute fulminant hepatitis D; chronic hepatitis D; liver fibrosis; end-stage liver disease; hepatocellular carcinoma.

In one aspect, the present invention provides methods of treating a subject having a Hepatitis D virus (HDV) infection. The methods include administering to the subject a therapeutically effective amount of a composition for inhibiting expression of hepatitis D virus (HDV) in a cell. The composition includes: (a) a first double-stranded RNAi agent comprising a first sense strand and a first antisense strand forming a double-stranded region, wherein substantially all of the nucleotides of the first sense strand and substantially all of the nucleotides of the first antisense strand are modified nucleotides, wherein the first sense strand is conjugated to a ligand attached at the 3'-terminus, and wherein the ligand is one or more GalNAc derivatives attached through a bivalent or trivalent branched linker; and (b) a second double-stranded RNAi agent comprising a second sense strand and a second antisense strand forming a double-stranded region, wherein substantially all of the nucleotides of the second sense strand and substantially all of the nucleotides of the second antisense strand are modified nucleotides, wherein the second sense strand is conjugated to a ligand attached at the 3'-terminus, and wherein the ligand is one or more GalNAc derivatives attached through a bivalent or trivalent branched linker; wherein the first and second sense strands each independently comprise a sequence selected from the group consisting of any one of the sense sequences in any one of Tables 11, 12, 31, and 32 (or a nucleotide sequence which is at least 90%, 91%, 92%, 93%, 94%, 95%, 96%, 97%, 98%, or 99% identical over its entire length to any of the foregoing nucleotide sequences), and wherein the first and second antisense strands each independently comprise a sequence selected from the group consisting of any one of the antisense sequences from any one of Tables 11, 12, 31, and 32 (or a nucleotide sequence which is at least 90%, 91%, 92%, 93%, 94%, 95%, 96%, 97%, 98%, or 99% identical over its entire length to any of the foregoing nucleotide sequences), thereby treating the subject.

In one embodiment, the first and second sense strands each independently comprise a sequence selected from the group consisting of any one of the sense sequences from AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1 (or a nucleotide sequence which is at least 90%, 91%, 92%, 93%, 94%, 95%, 96%, 97%, 98%, or 99% identical over its entire length to the foregoing nucleotide sequences).

In another embodiment, the first and second antisense strands each independently comprise a sequence selected from the group consisting of any one of the antisense sequences from AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1 (or a nucleotide sequence which is at least 90%, 91%, 92%, 93%, 94%, 95%, 96%, 97%, 98%, or 99% identical over its entire length to the foregoing nucleotide sequences).

In another aspect, the present invention provides methods of treating a subject having a Hepatitis D virus (HDV)-associated disorder. The methods include administering to the subject a therapeutically effective amount of a composition for inhibiting expression of hepatitis D virus (HDV) in a cell. The composition includes: (a) a first double-stranded RNAi agent comprising a first sense strand and a first antisense strand forming a double-stranded region, wherein substantially all of the nucleotides of the first sense strand and substantially all of the nucleotides of the first antisense strand are modified nucleotides, wherein the first sense strand is conjugated to a ligand attached at the 3'-terminus, and wherein the ligand is one or more GalNAc derivatives attached through a bivalent or trivalent branched linker; and (b) a second double-stranded RNAi agent comprising a second sense strand and a second antisense strand forming a double-stranded region, wherein substantially all of the nucleotides of the second sense strand and substantially all of the nucleotides of the second antisense strand are modified nucleotides, wherein the second sense strand is conjugated to a ligand attached at the 3'-terminus, and wherein the ligand is one or more GalNAc derivatives attached through a bivalent or trivalent branched linker; wherein the first and second sense strands each independently comprise a sequence selected from the group consisting of any one of the sense sequences from any one of Tables 11, 12, 31, and 32 (or a nucleotide sequence which is at least 90%, 91%, 92%, 93%, 94%, 95%, 96%, 97%, 98%, or 99% identical over its entire length to any of the foregoing nucleotide sequences), and wherein the first and second antisense strands each independently comprise a sequence selected from the group consisting of any one of the antisense sequences from any one of Tables 11, 12, 31, and 32 (or a nucleotide sequence which is at least 90%, 91%, 92%, 93%, 94%, 95%, 96%, 97%, 98%, or 99% identical over its entire length to any of the foregoing nucleotide sequences), thereby treating the subject.

In one embodiment, the first and second sense strands each independently comprise a sequence selected from the group consisting of any one of the sense sequences from AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1 (or a nucleotide sequence which is at least 90%, 91%, 92%, 93%, 94%, 95%, 96%, 97%, 98%, or 99% identical over its entire length to the foregoing nucleotide sequences).

In another embodiment, the first and second antisense strands each independently comprise a sequence selected from the group consisting of any one of the antisense sequences from AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1 (or a nucleotide sequence which is at least 90%, 91%, 92%, 93%, 94%, 95%, 96%, 97%, 98%, or 99% identical over its entire length to the foregoing nucleotide sequences).

In one embodiment, all of the nucleotides of the first and second sense strand and all of the nucleotides of the first and second antisense strand comprise a modification.

In one embodiment, the at least one of the modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic.

In one embodiment, the ligand is

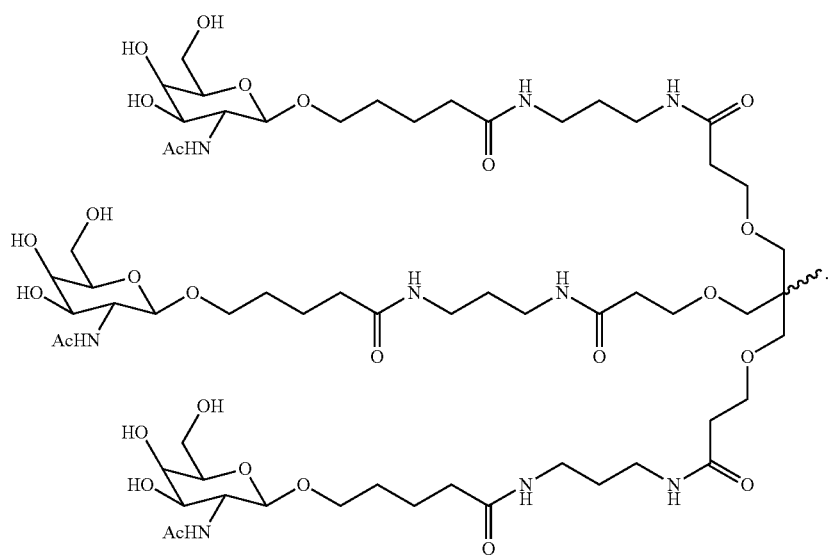 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one embodiment, the RNAi agent is conjugated to the ligand as shown in the following schematic

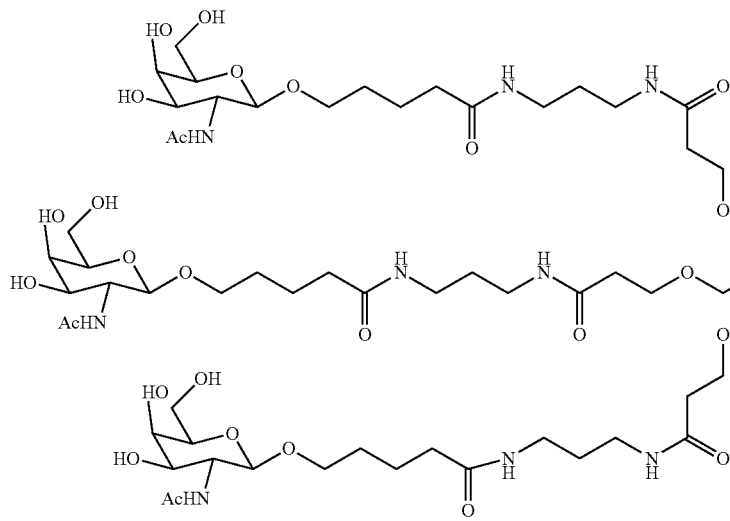
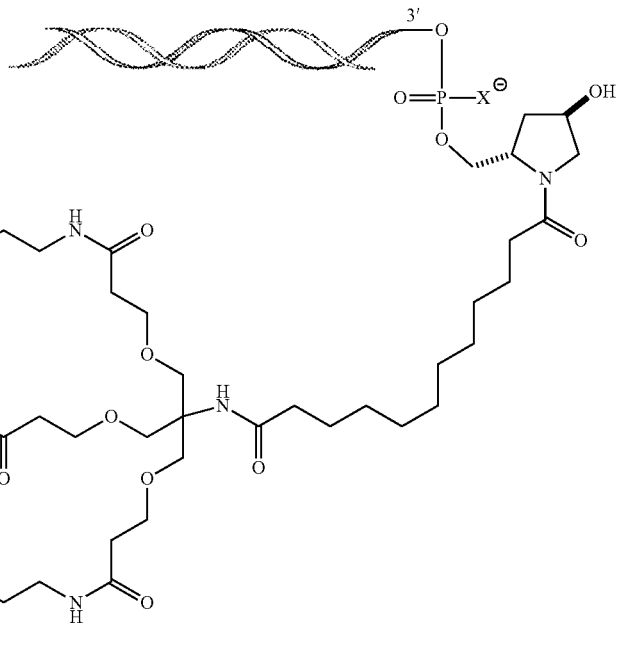

wherein X is O or S.

In one embodiment, the subject is a human.

In one embodiment, the HDV-associated disorder is selected from the group consisting of hepatitis B virus infection, acute hepatits B, acute hepatitis D; acute fulminant hepatitis D; chronic hepatitis D; liver fibrosis; end-stage liver disease; hepatocellular carcinoma.

In some embodiments, the methods of the invention further comprise treatment of hepatitis B virus (HBV) in the subject. Methods of treatment can include any methods of treatment known in the art. In certain embodiments, HBV is treated in the subject using one of more if the iRNA agents provided herein.

In some embodiments, the methods of the invention further include methods to modulate, preferably decrease the expression of PD-L1. Compositions and methods to reduce the expression of PD-L1 are provided, for example, in PCT publication no. WO2011/127180, which is hereby incorporated by reference.

In one embodiment, the double stranded RNAi agent is administered at a dose of about 0.01 mg/kg to about 10 mg/kg or about 0.5 mg/kg to about 50 mg/kg.

In one embodiment, the double stranded RNAi agent is administered at a dose of about 10 mg/kg to about 30 mg/kg. In another embodiment, the double stranded RNAi agent is administered at a dose of about 3 mg/kg. In one embodiment, the double stranded RNAi agent is administered at a dose of about 10 mg/kg.

In one embodiment, the double stranded RNAi agent is administered at a dose of about 0.5 mg/kg twice per week.

In one embodiment, the double stranded RNAi agent is administered at a fixed dose of about 50 mg to 200 mg.

In one embodiment, the double stranded RNAi agent is administered subcutaneously. In another embodiment, the double stranded RNAi agent is administered intravenously. In another embodiment, the agent is administered intramuscularly.

In one embodiment, the RNAi agent is administered in two or more doses.

In one embodiment, the RNAi agent is administered at intervals selected from the group consisting of once every about 12 hours, once every about 24 hours, once every about 48 hours, once every about 72 hours, and once every about 96 hours.

In one embodiment, the RNAi agent is administered twice per week. In another embodiment, the RNAi agent is administered every other week.

In one embodiment, the methods of the invention further include administering to the subject an additional therapeutic agent.

In one embodiment, the additional therapeutic agent is selected from the group consisting of an antiviral agent, a reverse transcriptase inhibitor, an immune stimulator, a therapeutic vaccine, a viral entry inhibitor, an oligonucleotide that inhibits the secretion or release of HbsAg, a capsid inhibitor, a cccDNA inhibitor, a double-stranded iRNA agent targeting HBV, and a combination of any of the foregoing.

In another embodiment, the methods of the invention further include administering to the subject a reverse transcriptase inhibitor. In yet another embodiment, the methods of the invention further include administering to the subject a reverse transcriptase inhibitor and an immune stimulator.

In one embodiment, the reverse transcriptase inhibitor is slected from the group consisting of Tenofovir disoproxil fumarate (TDF), Tenofovir alafenamide, Lamivudine, Adefovir dipivoxil, Entecavir (ETV), Telbivudine, and AGX-1009.

In one embodiment, the immune stimulator is selected from the group consisting of pegylated interferon alfa 2a (PEG-IFN-α2a), Interferon alfa-2b, a recombinant human interleukin-7, and aToll-like receptor 7 (TLR7) agonist.

In one embodiment, the double-stranded iRNA agent targeting HBV is any one of the agents provided in any one of Tables 3, 4, 6, 14, 15, 24, 25, 27, and 28. In another embodiment, the agent is AD-65403, AD-66810, or a combination thereof.

DETAILED DESCRIPTION OF THE INVENTION

The present invention provides iRNA compositions, which effect the RNA-induced silencing complex (RISC)-mediated cleavage of RNA transcripts of a Hepatitis D virus (HDV) gene. The gene may be within a cell, e.g., a cell within a subject, such as a human. The use of these iRNAs enables the targeted degradation of mRNAs of the correponding gene (HDV gene) in mammals.

The RNAi agents of the invention have been designed to target regions in the HDV across various clades of HDV.

Also provided herein are HBV targeted RNAi agents of that have been designed to inhibit all steps of the HBV life cycle, e.g., replication, assembly, secretion of virus, and secretion of sub-viral antigens, by inhibiting expression of more than one HBV gene. In particular, since transcription of the HBV genome results in polycistronic, overlapping RNAs, an RNAi agent of the invention targeting a single HBV gene results in significant inhibition of expression of most or all HBV transcripts. For example, because the HBV genome is transcribed into a single mRNA, an RNAi agent of the invention targeting the S gene will result in inhibition of not only S gene expression but also the expression of the "downstream" reverse transcriptase gene. Furthermore, the RNAi agents of the invention have been designed to inhibit HBV viral replication by targeting HBV structural genes, and the HBV X gene thereby permiting a subject's immune sytem to detect and respond to the presence of HBsAg to produce anti-HBV antibodies to clear an HBV infection.

HDV infection requires the presence of an HBV infection. Using in vitro assays, the present inventors have demonstrated that iRNA targeting HDV can potently mediate RNAi, resulting in significant inhibition of expression of the HDV gene. Moreover, using in vitro and in vivo assays, it is demonstrated herein that iRNAs targeting an HBV gene can potently mediate RNAi, resulting in significant inhibition of expression of more than one HBV gene, is effective in treating HDV infection as well. Thus, methods and compositions including these iRNAs are useful for treating a subject having an HDV infection and/or an HDV-associated disease, by administration of a iRNA targeted to one or both of HBV and HDV. Further, the compositions provided herein can be used in a subject with an HBV infection to prevent the development of an HDV infection.

Accordingly, the present invention also provides methods for treating a subject having a disorder that would benefit from inhibiting or reducing the expression of an HBV gene, e.g., HDV infection, using iRNA compositions which effect the RNA-induced silencing complex (RISC)-mediated cleavage of RNA transcripts of an HBV gene.

Very low dosages of the iRNAs of the invention, in particular, can specifically and efficiently mediate RNA interference (RNAi), resulting in significant inhibition of expression of the correponding gene (HDV gene).

The iRNAs of the invention include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of an HBV gene.

The following detailed description discloses how to make and use compositions containing iRNAs to inhibit the expression of an angiotensinogen gene as well as compositions, uses, and methods for treating subjects having diseases and disorders that would benefit from inhibition and/or reduction of the expression of an HDV gene.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise.

As used herein, "Hepatitis D virus," used interchangeably with the term "HDV" refers to the well-known noncytopathic, liver-tropic DNA virus belonging to the Hepadnaviridae family See, e.g., Ciancio and Rizzetto, Nat. Rev. 11:68-71, 2014; Le Gal et al., Emerg. Infect. Dis. 12:1447-1450, 2006; and Abbas and afzal, World J. Hep., 5:666-675, 2013, all of which are incorporated by reference. Unless otherwise indictate, HDV refers to all clades and variants of HDV.

HDV produces one protein, namely HDAg. It comes in two forms; a 27 kDa large-HDAg (also referred to herein as lHD and large HDV antigen), and a small-HDAg of 24 kDa (also referred to herein as sHD and small HDV antigen). The N-terminals of the two forms are identical, they differ by 19 more amino acids in the C-terminal of the large HDAg. Both isoforms are produced from the same reading frame which contains an UAG stop codon at codon 196, which normally produces only the small-HDAg. However, editing by cellular enzyme adenosine deaminase-1 changes the stop codon to UCG, allowing the large-HDAg to be produced. Despite having 90% identical sequences, these two proteins play diverging roles during the course of an infection. HDAg-S is produced in the early stages of an infection and enters the nucleus and supports viral replication. HDAg-L, in contrast, is produced during the later stages of an infection, acts as an inhibitor of viral replication, and is required for assembly of viral particles.

Additional examples of HDV mRNA sequences are readily available using publicly available databases, e.g., GenBank, UniProt, and OMIM.

The term"HDV," as used herein, also refers to naturally occurring DNA sequence variations of the HDV genome.

As used herein, "Hepatitis B virus," used interchangeably with the term "HBV" refers to the well-known noncytopathic, liver-tropic DNA virus belonging to the Hepadnaviridae family.

The HBV genome is partially double-stranded, circular DNA with overlapping reading frames.

There are four known genes encoded by the HBC genome, called C, X, P, and S. The core protein is coded for by gene C (HBcAg). Hepatitis B antigen (HBeAg) is produced by proteolytic processing of the pre-core (pre-C) protein. The DNA polymerase is encoded by gene P. Gene S is the gene that codes for the surface antigen (HBsAg). The HBsAg gene is one long open reading frame but contains three in frame "start" (ATG) codons that divide the gene into three sections, pre-S1, pre-S2, and S. Because of the multiple start codons, polypeptides of three different sizes called large, middle, and small (pre-S1+pre-S2+S, pre-S2+S, or S) are produced. The function of the non-structural protein coded for by gene X is not fully understood but it is associated with the development of liver cancer and encodes a decoy protein which permits HBsAg in the blood to sequester anti-HBsAg antibodies and allow infectious viral particles to escape immune detection.

The proteins encoded by the HBV genome include: envelope proteins—i) small, Hepatitis B surface antigen (HBsAg); ii) middle—preS2 plus HBsAg; iii) large—preS1 plus preS2 plus HBsAg; nucleocapsid protein, hepatitis B core antigen (HBcAg). Hepatitis B e antigen (HBeAg) is a non-structural protein produced during the HBV replication which shares 90% amino acids with the nucleocapsid HBcAg; and the X protein is a nonstructural protein (HBx) which functions in the cytoplasm to activate various signaling pathways, many of which are controlled by modulation of cytosolic calcium and in the nucleus to regulate transcription through a direct interaction with different transcription factors and, in some cases, enhance their binding to specific transcription elements.

HBV is one of the few DNA viruses that utilize reverse transcriptase in the replication process which involves multiple stages including entry, uncoating and transport of the virus genome to the nucleus. Initially, replication of the HBV genome involves the generation of an RNA intermediate that is then reverse transcribed to produce the DNA viral genome.

Upon infection of a cell with HBV, the viral genomic relaxed circular DNA (rcDNA) is transported into the cell nucleus and converted into episomal covalently closed circular DNA (cccDNA), which serves as the transcription template for the viral mRNAs. After transcription and nuclear export, cytoplasmic viral pregenomic RNA (pgRNA) is assembled with HBV polymerase and capsid proteins to form the nucleocapsid, inside which polymerase-catalyzed reverse transcription yields minus-strand DNA, which is subsequently copied into plus-strand DNA to form the progeny rcDNA genome. The mature nucleocapsids are then either packaged with viral envelope proteins to egress as virion particles or shuttled to the nucleus to amplify the cccDNA reservoir through the intracellular cccDNA amplification pathway. cccDNA is an essential component of the HBV replication cycle and is responsible for the establishment of infection and viral persistence.

HBV infection results in the production of two different particles: 1) the HBV virus itself (or Dane particle) which includes a viral capsid assembled from the HBcAg and is covered by the HBsAg and is capable of reinfecting cells and 2) subviral particles (or SVPs) which are high density lipoprotein-like particles comprised of lipids, cholesterol, cholesterol esters and the small and medium forms of the hepatitis B surface antigen HBsAg which are non-infectious. For each viral particle produced, 1,000-10,000 SVPs are released into the blood. As such SVPs (and the HBsAg protein they carry) represent the overwhelming majority of viral protein in the blood. HBV infected cells also secrete a soluble proteolytic product of the pre-core protein called the HBV e-antigen (HBeAg).

Eight genotypes of HBV, designated A to H, have been determined, each having a distinct geographical distribution. The virus is non-cytopathic, with virus-specific cellular immunity being the main determinant for the outcome of exposure to HBV-acute infection with resolution of liver diseases with 6 months, or chronic HBV infection that is frequently associated with progressive liver injury.

The term "HBV" includes any of the eight genotypes of HBV (A to H). The amino acid and complete coding sequence of the reference sequence of the HBV genome may be found in for example, GenBank Accession Nos. GI:21326584 (SEQ ID NO:1) and GI:3582357 (SEQ ID NO:3).

Additional examples of HBV mRNA sequences are readily available using publicly available databases, e.g., GenBank, UniProt, and OMIM.

The term"HBV," as used herein, also refers to naturally occurring DNA sequence variations of the HBV genome.

As used herein, "target sequence" refers to a contiguous portion of the nucleotide sequence of an mRNA molecule formed during the transcription of an HDV gene, including mRNA that is a product of RNA processing of a primary transcription product. In one embodiment, the target portion of the sequence will be at least long enough to serve as a substrate for iRNA-directed cleavage at or near that portion of the nucleotide sequence of an mRNA molecule formed during the transcription of an HDV gene.

The target sequence may be from about 9-36 nucleotides in length, e.g., about 15-30 nucleotides in length. For example, the target sequence can be from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide, as further detailed below, or a surrogate replacement moiety (see, e.g., Table 2). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent,", "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of an HDV gene (e.g., one or more HDV genes) in a cell, e.g., a cell within a subject, such as a mammalian subject.

In one embodiment, an RNAi agent of the invention includes a single stranded RNA that interacts with a target RNA sequence, e.g., an HDV target mRNA sequence, to direct the cleavage of the target RNA. Without wishing to be bound by theory it is believed that long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (siRNA) generated within a cell and which promotes the formation of a RISC complex to effect silencing of the target gene, i.e., an HDV gene. Accordingly, the term "siRNA" is also used herein to refer to an RNAi as described above.

In another embodiment, the RNAi agent may be a single-stranded siRNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In another embodiment, an "iRNA" for use in the compositions, uses, and methods of the invention is a double-stranded RNA and is referred to herein as a "double stranded RNAi agent," "double-stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., an HDV gene. In some embodiments of the invention, a double-stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide and/or a modified nucleotide. In addition, as used in this specification, an "RNAi agent" may include ribonucleotides with chemical modifications; an RNAi agent may include substantial modifications at multiple nucleotides. As used herein, the term "modified nucleotide" refers to a nucleotide having, independently, a modified sugar moiety, a modified internucleotide linkage, and/or modified nucleobase. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "RNAi agent" for the purposes of this specification and claims.

The duplex region may be of any length that permits specific degradation of a desired target RNA through a RISC pathway, and may range from about 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, at least 3, at least 4, at least 5, at least 6, at least 7, at least 8, at least 9, at least 10, at least 20, at least 23 or more unpaired nucleotides.

Where the two substantially complementary strands of a dsRNA are comprised by separate RNA molecules, those molecules need not, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs.

In one embodiment, an RNAi agent of the invention is a dsRNA of 24-30 nucleotides that interacts with a target RNA sequence, e.g., an HDV target mRNA sequence, to direct the cleavage of the target RNA. Without wishing to be bound by theory, long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188).

As used herein, the term "nucleotide overhang" refers to at least one unpaired nucleotide that protrudes from the duplex structure of an iRNA, e.g., a dsRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

In one embodiment, the antisense strand of a dsRNA has a 1-10 nucleotide, e.g., a 1, 2, 3, 4, 5, 6, 7, 8, 9, or 10 nucleotide, overhang at the 3'-end and/or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end and/or the 5'-end. In another embodiment, one or more of the nucleotides in the overhang is replaced with a nucleoside thiophosphate.

"Blunt" or "blunt end" means that there are no unpaired nucleotides at that end of the double stranded RNAi agent, i.e., no nucleotide overhang. A "blunt ended" RNAi agent is a dsRNA that is double-stranded over its entire length, i.e., no nucleotide overhang at either end of the molecule. The RNAi agents of the invention include RNAi agents with nucleotide overhangs at one end (i.e., agents with one overhang and one blunt end) or with nucleotide overhangs at both ends.

The term "antisense strand" or "guide strand" refers to the strand of an iRNA, e.g., a dsRNA, which includes a region that is substantially complementary to a target sequence, e.g., a HDV mRNA. As used herein, the term "region of complementarity" refers to the region on the antisense strand that is substantially complementary to a sequence, for example a target sequence, e.g., an HDV nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, 2, or 1 nucleotides of the 5'- and/or 3'-terminus of the iRNA. In one embodiment, a double-stranded RNAi agent of the invention include a nucleotide mismatch in the antisense strand. In another embodiment, a double-stranded RNAi agent of the invention include a nucleotide mismatch in the sense strand. In one embodiment, the nucleotide mismatch is, for example, within 5, 4, 3, 2, or 1 nucleotides from the 3'-terminus of the iRNA. In another embodiment, the nucleotide mismatch is, for example, in the 3'-terminal nucleotide of the iRNA.

The term "sense strand," or "passenger strand" as used herein, refers to the strand of an iRNA that includes a region that is substantially complementary to a region of the antisense strand as that term is defined herein.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs and/or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary" and "substantially complementary" herein can be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding an HDV gene). For example, a polynucleotide is complementary to at least a part of an HDV mRNA if the sequence is substantially complementary to a non-interrupted portion of an mRNA encoding an HDV gene.

Accordingly, in some embodiments, the sense strand polynucleotides and the antisense polynucleotides disclosed herein are fully complementary to the target HDV sequence. In other embodiments, the sense strand polynucleotides and/or the antisense polynucleotides disclosed herein are substantially complementary to the target HDV sequence and comprise a contiguous nucleotide sequence which is at least about 80% complementary over its entire length to the equivalent region of the nucleotide sequence of any one of the sequences in Tables 11, 12, 31, and 32, or a fragment of any one of the sequences in Tables 11, 12, 31, and 32, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent of the invention includes a sense strand that is substantially complementary to the target HDV sequence and comprise a contiguous nucleotide sequence which is at least about 80% complementary over its entire length to the equivalent region of the nucleotide sequence of any one of the sequences in Tables 11, 12, 31, and 32, or a fragment of any one of the sequences in Tables 11, 12, 31, and 32, such as about 85%, about 86%, about 87%, about 88%, about 89%, about 90%, about % 91%, about 92%, about 93%, about 94%, about 95%, about 96%, about 97%, about 98%, or about 99% complementary.

In another embodiment, an RNAi agent of the invention includes an antisense strand that is substantially complementary to the target HDV sequence and comprise a contiguous nucleotide sequence which is at least about 80% complementary over its entire length to the equivalent region of the nucleotide sequence of any one of the sequences in Tables 11, 12, 31, and 32, or a fragment of any one of the sequences in Tables 11, 12, 31, and 32, such as about 85%, about 86%, about 87%, about 88%, about 89%, about 90%, about % 91%, about 92%, about 93%, about 94%, about 95%, about 96%, about 97%, about 98%, or about 99% complementary.

In some embodiments, the RNAi agents for use in the invention target HBV. In some embodiment, such agents are fully complementary to the target HBV sequence. In other embodiments, the sense strand polynucleotides and/or the antisense polynucleotides disclosed herein are substantially complementary to the target HBV sequence and comprise a contiguous nucleotide sequence which is at least about 80% complementary over its entire length to the equivalent region of the nucleotide sequence of any one of the nucleotide sequences of the agents targeting HBV provided herein, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent targeting HBV for use in the present invention includes a sense strand that is substantially complementary to the target HBV sequence and comprise a contiguous nucleotide sequence which is at least about 80% complementary over its entire length to the equivalent region of the nucleotide sequence of any one of the nucleotide sequences of the agents targeting HBV provided herein, such as about 85%, about 86%, about 87%, about 88%, about 89%, about 90%, about % 91%, about 92%, about 93%, about 94%, about 95%, about 96%, about 97%, about 98%, or about 99% complementary.

In another embodiment, an RNAi agent targeting HBV for use in the present invention includes an antisense strand that is substantially complementary to the target HBV sequence and comprise a contiguous nucleotide sequence which is at least about 80% complementary over its entire length to the equivalent region of the nucleotide sequence of any one of the nucleotide sequences of the agents targeting HBV provided herein, or a fragment of any one of the nucleotide sequences of the agents targeting HBV provided herein, such as about 85%, about 86%, about 87%, about 88%, about 89%, about 90%, about % 91%, about 92%, about 93%, about 94%, about 95%, about 96%, about 97%, about 98%, or about 99% complementary.

In general, the majority of nucleotides of each strand are ribonucleotides, but as described in detail herein, each or both strands can also include one or more non-ribonucleotides, e.g., a deoxyribonucleotide and/or a modified nucleotide. In addition, an "iRNA" may include ribonucleotides with chemical modifications. Such modifications may include all types of modifications disclosed herein or known in the art. Any such modifications, as used in an iRNA molecule, are encompassed by "iRNA" for the purposes of this specification and claims.

In one aspect of the invention, an agent for use in the methods and compositions of the invention is a single-stranded antisense RNA molecule that inhibits a target mRNA via an antisense inhibition mechanism. The single-stranded antisense RNA molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense RNA molecule may be about 15 to about 30 nucleotides in length and have a sequence that is complementary to a target sequence. For example, the single-stranded antisense RNA molecule may comprise a sequence that is at least about 15, 16, 17, 18, 19, 20, or more contiguous nucleotides from any one of the antisense sequences described herein.

As used herein, a "subject" is an animal, such as a mammal, including a primate (such as a human, a non-human primate, e.g., a monkey, and a chimpanzee), a non-primate (such as a cow, a pig, a camel, a llama, a horse, a goat, a rabbit, a sheep, a hamster, a guinea pig, a cat, a dog, a rat, a mouse, a horse, and a whale), or a bird (e.g., a duck or a goose). In an embodiment, the subject is a human, such as a human being treated or assessed for a disease, disorder or condition that would benefit from reduction in HDV gene expression and/or replication; a human at risk for a disease, disorder or condition that would benefit from reduction in HDV gene expression and/or replication; a human having a disease, disorder or condition that would benefit from reduction in HDV gene expression and/or replication; and/or human being treated for a disease, disorder or condition that would benefit from reduction in HDV gene expression and/or replication, as described herein.

As used herein, the terms "treating" or "treatment" refer to a beneficial or desired result including, but not limited to, alleviation or amelioration of one or more symptoms associated with unwanted HDV gene expression and/or HDV replication. "Treatment" can also mean prolonging survival as compared to expected survival in the absence of treatment.

The term "lower" in the context of the level of HDV gene expression and/or HDV replication in a subject or a disease marker or symptom refers to a statistically significant decrease in such level. The decrease can be, for example, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or more and is preferably down to a level accepted as within the range of normal for an individual without such disorder. In certain embodiments, the expression of the target is normalized, i.e., decreased to a level accepted as within the range of normal for an individual without such disorder, e.g., the level of a disease marker, such as, ALT or AST, is decreased to a level accepted as within the range of normal for an individual without such disorder.

As used herein, "prevention" or "preventing," when used in reference to a disease, disorder or condition thereof, that would benefit from a reduction in expression of an HDV gene and/or replication, refers to a reduction in the likelihood that a subject will develop a symptom associated with such a disease, disorder, or condition, e.g., a symptom of unwanted HDV infection, such as the presence of serum and/or liver HDV ccc DNA, the presence of serum HDV DNA, the presence of serum and/or liver HDV antigen.

As used herein, the term "Hepatitis D virus-associated disease" or "HDV-associated disease," is a disease or disorder that is caused by, or associated with HDV infection and/or replication. The term "HDV-associated disease" includes a disease, disorder or condition that would benefit from reduction in HDV gene expression and/or replication. Non-limiting examples of HDV-associated diseases include, for example, hepatitis B virus infection, acute hepatits B, acute hepatitis D; acute fulminant hepatitis D; chronic hepatitis D; liver fibrosis; end-stage liver disease; hepatocellular carcinoma.

"Therapeutically effective amount," as used herein, is intended to include the amount of an RNAi agent that, when administered to a patient for treating a subject having an HDV infection and/or HDV-associated disease, is sufficient to effect treatment of the disease (e.g., by diminishing, ameliorating or maintaining the existing disease or one or more symptoms of disease). The "therapeutically effective amount" may vary depending on the RNAi agent, how the agent is administered, the disease and its severity and the history, age, weight, family history, genetic makeup, stage of pathological processes mediated by HDV gene expression, the types of preceding or concomitant treatments, if any, and other individual characteristics of the patient to be treated.

"Prophylactically effective amount," as used herein, is intended to include the amount of an RNAi agent that, when administered to a subject who does not yet experience or display symptoms of an HDV infection and/or HDV-associated disease, but who may be predisposed, is sufficient to prevent or ameliorate the disease or one or more symptoms of the disease. Ameliorating the disease includes slowing the course of the disease or reducing the severity of later-developing disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylacticaly effective amount" also includes an amount of an RNAi agent that produces some desired local or systemic effect at a reasonable benefit/risk ratio applicable to any treatment. RNAi agents employed in the methods of the present invention may be administered in a sufficient amount to produce a reasonable benefit/risk ratio applicable to such treatment.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes), the retina or parts of the retina (e.g., retinal pigment epithelium), the central nervous system or parts of the central nervous system (e.g., ventricles or choroid plexus), or the pancreas or certain cells or parts of the pancreas. In some embodiments, a "sample derived from a subject" refers tocerebrospinal fluid obtained from the subject. In preferred embodiments, a "sample derived from a subject" refers to blood or plasma drawn from the subject. In further embodiments, a "sample derived from a subject" refers to liver tissue (or subcomponents thereof) or retinal tissue (or subcomponents thereof) derived from the subject.

II. iRNAs of the Invention

The present invention provides iRNAs which inhibit the expression of one or more HDV genes. In one embodiment, the iRNA agent includes double-stranded ribonucleic acid (dsRNA) molecules for inhibiting the expression of an HDV gene in a cell, such as a cell within a subject, e.g., a mammal, such as a human having an HDV-associated disease, e.g., chronic hepatitis D. The dsRNA includes an antisense strand having a region of complementarity which is complementary to at least a part of an mRNA formed in the expression of an HDV gene. The region of complementarity is about 30 nucleotides or less in length (e.g., about 30, 29, 28, 27, 26, 25, 24, 23, 22, 21, 20, 19, or 18 nucleotides or less in length). Upon contact with a cell expressing the HDV gene, the iRNA inhibits the expression of the HDV gene (e.g., a human, a primate, a non-primate, or a bird HDV gene) by at least about 10% as assayed by, for example, a PCR or branched DNA (bDNA)-based method, or by a protein-based method, such as by immunofluorescence analysis, using, for example, western Blotting or flowcytometric techniques.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of an HDV gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is between 15 and 30 base pairs in length, e.g., between, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

Similarly, the region of complementarity to the target sequence is between 15 and 30 nucleotides in length, e.g., between 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

In some embodiments, the dsRNA is between about 15 and about 20 nucleotides in length, or between about 25 and about 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 9 to 36 base pairs, e.g., about 10-36, 11-36, 12-36, 13-36, 14-36, 15-36, 9-35, 10-35, 11-35, 12-35, 13-35, 14-35, 15-35, 9-34, 10-34, 11-34, 12-34, 13-34, 14-34, 15-34, 9-33, 10-33, 11-33, 12-33, 13-33, 14-33, 15-33, 9-32, 10-32, 11-32, 12-32, 13-32, 14-32, 15-32, 9-31, 10-31, 11-31, 12-31, 13-32, 14-31, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target HDV gene expression is not generated in the target cell by cleavage of a larger dsRNA.

A dsRNA as described herein can further include one or more single-stranded nucleotide overhangs e.g., 1, 2, 3, or 4 nucleotides. dsRNAs having at least one nucleotide overhang can have unexpectedly superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand or any combination thereof. Furthermore, the nucleotide(s) of an overhang can be present on the 5'-end, 3'-end or both ends of either an antisense or sense strand of a dsRNA.

A dsRNA can be synthesized by standard methods known in the art as further discussed below, e.g., by use of an automated DNA synthesizer, such as are commercially available from, for example, Biosearch, Applied Biosystems, Inc.

iRNA compounds of the invention may be prepared using a two-step procedure. First, the individual strands of the double-stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Single-stranded oligonucleotides of the invention can be prepared using solution-phase or solid-phase organic synthesis or both.

In one aspect, a dsRNA of the invention includes at least two nucleotide sequences, a sense sequence and an antisense sequence. The sense strand is selected from the group of sequences provided in any one of Tables 11, 12, 31, and 32 and the corresponding antisense strand of the sense strand is selected from the group of sequences of any one of Tables 11, 12, 31, and 32. In this aspect, one of the two sequences is complementary to the other of the two sequences, with one of the sequences being substantially complementary to a sequence of an mRNA generated in the expression of an HDV gene. As such, in this aspect, a dsRNA will include two oligonucleotides, where one oligonucleotide is described as the sense strand in any one of Tables 11, 12, 31, and 32 and the second oligonucleotide is described as the corresponding antisense strand of the sense strand in any one of Tables 11, 12, 31, and 32. In one embodiment, the substantially complementary sequences of the dsRNA are contained on separate oligonucleotides. In another embodiment, the substantially complementary sequences of the dsRNA are contained on a single oligonucleotide.

It will be understood that, although some of the sequences in Tables 12 and 32 are described as modified and/or conjugated sequences, the RNA of the iRNA of the invention e.g., a dsRNA of the invention, may comprise any one of the sequences set forth in any one of Tables 11, 12, 31, and 32 that is un-modified, un-conjugated, and/or modified and/or conjugated differently than described therein.

The skilled person is well aware that dsRNAs having a duplex structure of between about 20 and 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided in any one of Tables 11, 12, 31, and 32, dsRNAs described herein can include at least one strand of a length of minimally 21 nucleotides. It can be reasonably expected that shorter duplexes having one of the sequences of any one of Tables 11, 12, 31, and 32 minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences of any one of Tables 11, 12, 31, and 32, and differing in their ability to inhibit the expression of a HDV gene by not more than about 5, 10, 15, 20, 25, or 30% inhibition from a dsRNA comprising the full sequence, are contemplated to be within the scope of the present invention.

In addition, the RNAs provided in any one of Tables 11, 12, 31, and 32 identify a site(s) in a HDV transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 15 contiguous nucleotides from one of the sequences provided Many one of Tables 11, 12, 31, and 32 coupled to additional nucleotide sequences taken from the region contiguous to the selected sequence in a HDV gene.

While a target sequence is generally about 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that can serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with an iRNA agent, mediate the best inhibition of target gene expression. Thus, while the sequences identified, for example, in any one of Tables 11, 12, 31, and 32 represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified, e.g., Many one of Tables 11, 12, 31, and 32, further optimization could be achieved by systematically either adding or removing nucleotides to generate longer or shorter sequences and testing those sequences generated by walking a window of the longer or shorter size up or down the target RNA from that point. Again, coupling this approach to generating new candidate targets with testing for effectiveness of iRNAs based on those target sequences in an inhibition assay as known in the art and/or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art and/or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes) as an expression inhibitor.

An iRNA as described herein can contain one or more mismatches to the target sequence. In one embodiment, an iRNA as described herein contains no more than 3 mismatches. If the antisense strand of the iRNA contains mismatches to a target sequence, it is preferable that the area of mismatch is not located in the center of the region of complementarity. If the antisense strand of the iRNA contains mismatches to the target sequence, it is preferable that the mismatch be restricted to be within the last 5 nucleotides from either the 5'- or 3'-end of the region of complementarity. For example, for a 23 nucleotide iRNA agent the strand which is complementary to a region of an HDV gene, generally does not contain any mismatch within the central 13 nucleotides. The methods described herein or methods known in the art can be used to determine whether an iRNA containing a mismatch to a target sequence is effective in inhibiting the expression of an HDV gene. Consideration of the efficacy of iRNAs with mismatches in inhibiting expression of an HDV gene is important, especially if the particular region of complementarity in an HDV gene is known to have polymorphic sequence variation within the population.

III. Modified iRNAs of the Invention

In one embodiment, the RNA of the iRNA of the invention e.g., a dsRNA, is un-modified, and does not comprise, e.g., chemical modifications and/or conjugations known in the art and described herein. In another embodiment, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA of the invention are modified iRNAs of the invention in which "substantially all of the nucleotides are modified" are largely but not wholly modified and can include not more than 5, 4, 3, 2, or 1 unmodified nucleotides.

The nucleic acids featured in the invention can be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; and/or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and amino alkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 564,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677,439, the entire contents of each of which are hereby incorporated herein by reference.

In other embodiments, suitable RNA mimetics are contemplated for use in iRNAs, in which both the sugar and the internucleoside linkage, i.e., the backbone, of the nucleotide units are replaced with novel groups. The base units are maintained for hybridization with an appropriate nucleic acid target compound. One such oligomeric compound, an RNA mimetic that has been shown to have excellent hybridization properties, is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative U.S. patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science*, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— [wherein the native phosphodiester backbone is represented as —O—P—O—$CH_2$—] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position: OH; F; O—, S—, or N-alkyl; O—, S—, or N-alkenyl; O—, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—N($CH_2$)$_2$.

Other modifications include 2'-methoxy (2'-$OCH_3$), 2'-aminopropoxy (2'-$OCH_2CH_2CH_2NH_2$) and 2'-fluoro (2'-F) Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative U.S. patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as deoxy-thymine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

The RNA of an iRNA can also be modified to include one or more bicyclic sugar moieties. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH2-O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3):833-843; Grunweller, A. et al., (2003) *Nucleic Acids Research* 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge. Examples of such 4' to 2' bridged bicyclic nucleosides, include but are not limited to 4'-(CH2)-O-2' (LNA); 4'-(CH2)-S-2'; 4'-(CH2)2-O-2' (ENA); 4'-CH(CH3)-O-2' (also referred to as "constrained ethyl" or "cEt") and 4'-CH(CH2OCH3)-O-2' (and analogs thereof; see, e.g., U.S. Pat. No. 7,399,845); 4'-C(CH3)(CH3)-O-2' (and analogs thereof; see e.g., U.S. Pat. No. 8,278,283); 4'-CH2-N(OCH3)-2' (and analogs thereof; see e.g., U.S. Pat. No. 8,278,425); 4'-CH2-O—N(CH3)-2' (see, e.g., U.S. Patent Publication No. 2004/0171570); 4'-CH2-N(R)—O-2', wherein R is H, C1-C12 alkyl, or a protecting group (see, e.g., U.S. Pat. No. 7,427,672); 4'-CH2-C(H)(CH3)-2' (see, e.g., Chattopadhyaya et al., *J. Org. Chem.*, 2009, 74, 118-134); and 4'-CH2-C(=CH2)-2' (and analogs thereof; see, e.g., U.S. Pat. No. 8,278,426). The entire contents of each of the foregoing are hereby incorporated herein by reference.

Additional representative U.S. patents and US patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and (3-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH(CH3)-0-2' bridge. In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US Patent Publication No. 2013/0190383; and PCT publication WO 2013/036868, the entire contents of each of which are hereby incorporated herein by reference.

One or more of the nucleotides of an iRNA of the invention may also include a hydroxymethyl substituted nucleotide. A "hydroxymethyl substituted nucleotide" is an acyclic 2'-3'-seco-nucleotide, also referred to as an "unlocked nucleic acid" ("UNA") modification Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-0-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other modifications of the nucleotides of an iRNA of the invention include a 5' phosphate or 5' phosphate mimic, e.g., a 5'-terminal phosphate or phosphate mimic on the antisense strand of an RNAi agent. Suitable phosphate mimics are disclosed in, for example US Patent Publication No. 2012/0157511, the entire contents of which are incorporated herein by reference.

A. Modified iRNAs Comprising Motifs of the Invention

In certain aspects of the invention, the double-stranded RNAi agents of the invention include agents with chemical modifications as disclosed, for example, in WO 2013/075035, filed on Nov. 16, 2012, the entire contents of which are incorporated herein by reference. As shown herein and in PCT Publication No. WO 2013/075035, a superior result may be obtained by introducing one or more motifs of three identical modifications on three consecutive nucleotides into a sense strand and/or antisense strand of an RNAi agent, particularly at or near the cleavage site. In some embodiments, the sense strand and antisense strand of the RNAi agent may otherwise be completely modified. The introduction of these motifs interrupts the modification pattern, if present, of the sense and/or antisense strand. The RNAi agent may be optionally conjugated with a GalNAc derivative ligand, for instance on the sense strand. The resulting RNAi agents present superior gene silencing activity.

More specifically, it has been surprisingly discovered that when the sense strand and antisense strand of the double-stranded RNAi agent are completely modified to have one or more motifs of three identical modifications on three consecutive nucleotides at or near the cleavage site of at least one strand of an RNAi agent, the gene silencing acitivity of the RNAi agent was superiorly enhanced.

Accordingly, the invention provides double-stranded RNAi agents capable of inhibiting the expression of a target gene (i.e., HDV gene) in vivo. The RNAi agent comprises a sense strand and an antisense strand. Each strand of the RNAi agent may range from 12-30 nucleotides in length. For example, each strand may be between 14-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as an "RNAi agent." The duplex region of an RNAi agent may be 12-30 nucleotide pairs in length. For example, the duplex region can be between 14-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotides in length.

In one embodiment, the RNAi agent may contain one or more overhang regions and/or capping groups at the 3'-end, 5'-end, or both ends of one or both strands. The overhang can be 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In one embodiment, the nucleotides in the overhang region of the RNAi agent can each independently be a modified or unmodified nucleotide including, but no limited to 2'-sugar modified, such as, 2-F, 2'-Omethyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof. For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand or both strands of the RNAi agent may be phosphorylated. In some embodiments, the overhang region(s) contains two nucleotides having a phosphorothioate between the two nucleotides, where the two nucleotides can be the same or different. In one embodiment, the overhang is present at the 3'-end of the sense strand, antisense strand, or both strands. In one embodiment, this 3'-overhang is present in the antisense strand. In one embodiment, this 3'-overhang is present in the sense strand.

The RNAi agent may contain only a single overhang, which can strengthen the interference activity of the RNAi, without affecting its overall stability. For example, the single-stranded overhang may be located at the 3'-terminal end of the sense strand or, alternatively, at the 3'-terminal end of the antisense strand. The RNAi may also have a blunt end, located at the 5'-end of the antisense strand (or the 3'-end of the sense strand) or vice versa. Generally, the antisense strand of the RNAi has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In one embodiment, the RNAi agent is a double ended bluntmer of 19 nucleotides in length, wherein the sense strand contains at least one motif of three 2'-F modifications on three consecutive nucleotides at positions 7, 8, 9 from the 5'end. The antisense strand contains at least one motif of three 2'-O-methyl modifications on three consecutive nucleotides at positions 11, 12, 13 from the 5'end.

In another embodiment, the RNAi agent is a double ended bluntmer of 20 nucleotides in length, wherein the sense strand contains at least one motif of three 2'-F modifications on three consecutive nucleotides at positions 8, 9, 10 from the 5'end. The antisense strand contains at least one motif of three 2'-O-methyl modifications on three consecutive nucleotides at positions 11, 12, 13 from the 5'end.

In yet another embodiment, the RNAi agent is a double ended bluntmer of 21 nucleotides in length, wherein the sense strand contains at least one motif of three 2'-F modifications on three consecutive nucleotides at positions 9, 10, 11 from the 5'end. The antisense strand contains at least one motif of three 2'-O-methyl modifications on three consecutive nucleotides at positions 11, 12, 13 from the 5'end.

In one embodiment, the RNAi agent comprises a 21 nucleotide sense strand and a 23 nucleotide antisense strand, wherein the sense strand contains at least one motif of three 2'-F modifications on three consecutive nucleotides at positions 9, 10, 11 from the 5'end; the antisense strand contains at least one motif of three 2'-O-methyl modifications on three consecutive nucleotides at positions 11, 12, 13 from the 5'end, wherein one end of the RNAi agent is blunt, while the other end comprises a 2 nucleotide overhang. Preferably, the 2 nucleotide overhang is at the 3'-end of the antisense strand.

When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In one embodiment, every nucleotide in the sense strand and the antisense strand of the RNAi agent, including the nucleotides that are part of the motifs are modified nucleotides. In one embodiment each residue is independently modified with a 2'-O-methyl or 3'-fluoro, e.g., in an alternating motif. Optionally, the RNAi agent further comprises a ligand (preferably GalNAc$_3$).

In one embodiment, the RNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In one embodiment, the RNAi agent comprises sense and antisense strands, wherein the RNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end; wherein the 3' end of the first strand and the 5' end of the second strand form a blunt end and the second strand is 1-4 nucleotides longer at its 3' end than the first strand, wherein the duplex region which is at least 25 nucleotides in length, and the second strand is sufficiently complemenatary to a target mRNA along at least 19 nucleotide of the second strand length to reduce target gene expression when the RNAi agent is introduced into a mammalian cell, and wherein dicer cleavage of the RNAi agent preferentially results in an siRNA comprising the 3' end of the second strand, thereby reducing expression of the target gene in the mammal Optionally, the RNAi agent further comprises a ligand.

In one embodiment, the sense strand of the RNAi agent contains at least one motif of three identical modifications on three consecutive nucleotides, where one of the motifs occurs at the cleavage site in the sense strand.

In one embodiment, the antisense strand of the RNAi agent can also contain at least one motif of three identical modifications on three consecutive nucleotides, where one of the motifs occurs at or near the cleavage site in the antisense strand For an RNAi agent having a duplex region of 17-23 nucleotide in length, the cleavage site of the antisense strand is typically around the 10, 11 and 12 positions from the 5'-end. Thus the motifs of three identical modifications may occur at the 9, 10, 11 positions; 10, 11, 12 positions; 11, 12, 13 positions; 12, 13, 14 positions; or 13, 14, 15 positions of the antisense strand, the count starting from the $1^{st}$ nucleotide from the 5'-end of the antisense strand, or, the count starting from the $1^{st}$ paired nucleotide within the duplex region from the 5'-end of the antisense strand. The cleavage site in the antisense strand may also change according to the length of the duplex region of the RNAi from the 5'-end.

The sense strand of the RNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In one embodiment, the sense strand of the RNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adajacent to the first motif or is separated by at least one or more nucleotides. When the motifs are immediately adjacent to each other then the chemistry of the motifs are distinct from each other and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the RNAi agent may contain more than one motifs of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In one embodiment, the wing modification on the sense strand or antisense strand of the RNAi agent typically does not include the first one or two terminal nucleotides at the 3'-end, 5'-end or both ends of the strand.

In another embodiment, the wing modification on the sense strand or antisense strand of the RNAi agent typically does not include the first one or two paired nucleotides within the duplex region at the 3'-end, 5'-end or both ends of the strand.

When the sense strand and the antisense strand of the RNAi agent each contain at least one wing modification, the wing modifications may fall on the same end of the duplex region, and have an overlap of one, two or three nucleotides.

When the sense strand and the antisense strand of the RNAi agent each contain at least two wing modifications, the sense strand and the antisense strand can be so aligned that two modifications each from one strand fall on one end of the duplex region, having an overlap of one, two or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In one embodiment, every nucleotide in the sense strand and antisense strand of the RNAi agent, including the nucleotides that are part of the motifs, may be modified. Each nucleotide may be modified with the same or different modification which can include one or more alteration of one or both of the non-linking phosphate oxygens and/or of one or more of the linking phosphate oxygens; alteration of a constituent of the ribose sugar, e.g., of the 2' hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking 0 of a phosphate moiety. In some cases the modification will occur at all of the subject positions in the nucleic acid but in many cases it will not. By way of example, a modification may only occur at a 3' or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a RNA or may only occur in a single strand region of a RNA. For example, a phosphorothioate modification at a non-linking 0 position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5' end or ends can be phosphorylated.

It may be possible, e.g., to enhance stability, to include particular bases in overhangs, or to include modified nucleotides or nucleotide surrogates, in single strand overhangs, e.g., in a 5' or 3' overhang, or in both. For example, it can be desirable to include purine nucleotides in overhangs. In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In one embodiment, each residue of the sense strand and antisense strand is independently modified with LNA, CRN, cET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In one embodiment, the $N_a$ and/or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AAB-BAABBAABB . . . ," "AABAABAABAAB . . . ," "AAABAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABA-BAB . . . ", "ACACAC . . . " "BDBDBD . . . " or "CDCDCD . . . ," etc.

In one embodiment, the RNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5'-3' of the strand and the alternating motif in the antisense strand may start with "BABABA" from 5'-3' of the strand within the duplex region. As another example, the alternating motif in the sense strand may start with "AABBAABB" from 5'-3' of the strand and the alternating motif in the antisenese strand may start with "BBAABBAA" from 5'-3' of the strand within the duplex region, so that there is a complete or partial shift of the modification patterns between the sense strand and the antisense strand.

In one embodiment, the RNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand and/or antisense strand interrupts the initial modification pattern present in the sense strand and/or antisense strand. This interruption of the modification pattern of the sense and/or antisense strand by introducing one or more motifs of three identical modifications on three consecutive nucleotides to the sense and/or antisense strand surprisingly enhances the gene silencing acitivty to the target gene.

In one embodiment, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYN$_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ and/or $N_b$ may be present or absent when there is a wing modification present.

The RNAi agent may further comprise at least one phosphorothioate or methylphosphonate internucleotide linkage. The phosphorothioate or methylphosphonate internucleotide linkage modification may occur on any nucleotide of the sense strand or antisense strand or both strands in any position of the strand. For instance, the internucleotide linkage modification may occur on every nucleotide on the sense strand and/or antisense strand; each internucleotide linkage modification may occur in an alternating pattern on the sense strand and/or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-standed RNAi agent comprises 6-8phosphorothioate internucleotide linkages. In one embodiment, the antisense strand comprises two phosphorothioate internucleotide linkages at the 5'-terminus and two phosphorothioate internucleotide linkages at the 3'-terminus, and the sense strand comprises at least two phosphorothioate internucleotide linkages at either the 5'-terminus or the 3'-terminus.

In one embodiment, the RNAi comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, and/or the 5'end of the antisense strand.

In one embodiment, the 2 nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the RNAi agent may additionally have two phosphorothioate internucleotide linkages between the terminal three nucleotides at both the 5'-end of the sense strand and at the 5'-end of the antisense strand.

In one embodiment, the RNAi agent comprises mismatch(es) with the target, within the duplex, or combinations thereof. The mistmatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In one embodiment, the RNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In one embodiment, the nucleotide at the 1 position within the duplex region from the 5'-end in the antisense strand is selected from the group consisting of A, dA, dU, U, and dT. Alternatively, at least one of the first 1, 2 or 3 base pair within the duplex region from the 5'-end of the antisense strand is an AU base pair. For example, the first base pair within the duplex region from the 5'-end of the antisense strand is an AU base pair.

In another embodiment, the nucleotide at the 3'-end of the sense strand is deoxy-thymine (dT). In another embodiment, the nucleotide at the 3'-end of the antisense strand is deoxy-thymine (dT). In one embodiment, there is a short sequence of deoxy-thymine nucleotides, for example, two dT nucleotides on the 3'-end of the sense and/or antisense strand.

In one embodiment, the sense strand sequence may be represented by formula (I):

$$5'n_p\text{-}N_a\text{-}(XXX)_i\text{-}N_b\text{-}YYY\text{-}N_b\text{-}(ZZZ)_j\text{-}N_a\text{-}n_q 3' \qquad (I)$$

wherein:

i and j are each independently 0 or 1;

p and q are each independently 0-6;

each $N_a$ independently represents an oligonucleotide sequence comprising 0-25 modified nucleotides, each sequence comprising at least two differently modified nucleotides;

each $N_b$ independently represents an oligonucleotide sequence comprising 0-10 modified nucleotides;

each $n_p$ and $n_q$ independently represent an overhang nucleotide;

wherein Nb and Y do not have the same modification; and

XXX, YYY and ZZZ each independently represent one motif of three identical modifications on three consecutive nucleotides. Preferably YYY is all 2'-F modified nucleotides.

In one embodiment, the $N_a$ and/or $N_b$ comprise modifications of alternating pattern.

In one embodiment, the YYY motif occurs at or near the cleavage site of the sense strand. For example, when the RNAi agent has a duplex region of 17-23 nucleotides in length, the YYY motif can occur at or the vicinity of the cleavage site (e.g.: can occur at positions 6, 7, 8, 7, 8, 9, 8, 9, 10, 9, 10, 11, 10, 11, 12 or 11, 12, 13) of—the sense strand, the count starting from the 1st nucleotide, from the 5'-end; or optionally, the count starting at the 1st paired nucleotide within the duplex region, from the 5'-end.

In one embodiment, i is 1 and j is 0, or i is 0 and j is 1, or both i and j are 1. The sense strand can therefore be represented by the following formulas:

$$5'n_p\text{-}N_a\text{-}YYY\text{-}N_b\text{-}ZZZ\text{-}N_a\text{-}n_q 3' \qquad (Ib);$$

$$5'n_p\text{-}N_a\text{-}XXX\text{-}N_b\text{-}YYY\text{-}N_a\text{-}n_q 3' \qquad (Ic); \text{ or}$$

$$5'n_p\text{-}N_a\text{-}XXX\text{-}N_b\text{-}YYY\text{-}N_b\text{-}ZZZ\text{-}N_a\text{-}n_q 3' \qquad (Id).$$

When the sense strand is represented by formula (Ib), $N_b$ represents an oligonucleotide sequence comprising 0-10, 0-7, 0-5, 0-4, 0-2 or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2 or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2 or 0 modified nucleotides. Preferably, $N_b$ is 0, 1, 2, 3, 4, 5 or 6 Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

$$5'n_p\text{-}N_a\text{-}YYY\text{-}N_a\text{-}n_q 3' \qquad (Ia).$$

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

$$5'n_q\text{-}N_a'\text{-}(Z'Z'Z')_k\text{-}N_b'\text{-}Y'Y'Y'\text{-}N_b'\text{-}(X'X'X')_l\text{-}N_a'\text{-}n_p'3' \qquad (II)$$

wherein:

k and l are each independently 0 or 1;

p' and q' are each independently 0-6;

each $N_a'$ independently represents an oligonucleotide sequence comprising 0-25 modified nucleotides, each sequence comprising at least two differently modified nucleotides;

each $N_b'$ independently represents an oligonucleotide sequence comprising 0-10 modified nucleotides;

each $n_p'$ and $n_q'$ independently represent an overhang nucleotide;

wherein $N_b'$ and Y' do not have the same modification; and

X'X'X', Y'Y'Y' and Z'Z'Z' each independently represent one motif of three identical modifications on three consecutive nucleotides.

In one embodiment, the $N_a'$ and/or $N_b'$ comprise modifications of alternating pattern.

The Y'Y'Y' motif occurs at or near the cleavage site of the antisense strand. For example, when the RNAi agent has a duplex region of 17-23 nucleotide in length, the Y'Y'Y' motif can occur at positions 9, 10, 11; 10, 11, 12; 11, 12, 13; 12, 13, 14; or 13, 14, 15 of the antisense strand, with the count starting from the 1st nucleotide, from the 5'-end; or optionally, the count starting at the 1st paired nucleotide within the duplex region, from the 5'-end. Preferably, the Y'Y'Y' motif occurs at positions 11, 12, 13.

In one embodiment, Y'Y'Y' motif is all 2'-OMe modified nucleotides.

In one embodiment, k is 1 and l is 0, or k is 0 and l is 1, or both k and l are 1.

The antisense strand can therefore be represented by the following formulas:

$$5'n_q\text{-}N_a'\text{-}Z'Z'Z'\text{-}N_b'\text{-}Y'Y'Y'\text{-}N_a'\text{-}n_p 3' \qquad (IIb);$$

$$5'n_q\text{-}N_a'\text{-}Y'Y'Y'\text{-}N_b'\text{-}X'X'X'\text{-}n_p 3' \qquad (IIc); \text{ or}$$

$$5'n_q\text{-}N_a'\text{-}X'X'X'\text{-}N_b'\text{-}Y'Y'Y'\text{-}N_b'\text{-}X'X'X'\text{-}N_a'\text{-}n_p 3' \qquad (IId).$$

When the antisense strand is represented by formula (IIb), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2 or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5 or 6.

In other embodiments, k is 0 and l is 0 and the antisense strand may be represented by the formula:

$$5'n_p\text{-}N_a'\text{-}Y'Y'Y'\text{-}N_a'\text{-}n_q 3' \qquad (Ia).$$

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y' and Z', in particular, may represent a 2'-O-methyl modification or a 2'-fluoro modification.

In one embodiment, the sense strand of the RNAi agent may contain YYY motif occurring at 9, 10 and 11 positions of the strand when the duplex region is 21 nt, the count starting from the $1^{st}$ nucleotide from the 5'-end, or optionally, the count starting at the $1^{st}$ paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In one embodiment the antisense strand may contain Y'Y'Y' motif occurring at positions 11, 12, 13 of the strand, the count starting from the $1^{st}$ nucleotide from the 5'-end, or optionally, the count starting at the $1^{st}$ paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with a antisense strand being represented by any one of formulas (IIa), (IIb), (IIc), and (IId), respectively.

Accordingly, the RNAi agents for use in the methods of the invention may comprise a sense strand and an antisense strand, each strand having 14 to 30 nucleotides, the RNAi duplex represented by formula (III):

sense: 5'$n_p$-$N_a$-(XXX)$_i$-$N_b$-YYY-$N_b$-(ZZZ)$_j$-$N_a$-$n_q$3' antisense: 3'$n_p$'-$N_a$'-(X'X'X')$_k$-$N_b$'-Y'Y'Y'-$N_b$'-(Z'Z'Z')$_l$-$N_a$'-$n_q$'5'     (III)

wherein:
j, k, and l are each independently 0 or 1;
p, p', q, and q' are each independently 0-6;
each $N_a$ and $N_a$' independently represents an oligonucleotide sequence comprising 0-25 modified nucleotides, each sequence comprising at least two differently modified nucleotides;
each $N_b$ and $N_b$' independently represents an oligonucleotide sequence comprising 0-10 modified nucleotides;
wherein each $n_p$', $n_p$, $n_q$', and $n_q$, each of which may or may not be present, independently represents an overhang nucleotide; and
XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming a RNAi duplex include the formulas below:

5'$n_p$-$N_a$-YYY-$N_a$-$n_q$3'

3'$n_p$'-$N_a$'-Y'Y'Y'-$N_a$'$n_q$'5'     (IIIa)

5'$n_p$-$N_a$-YYY-$N_b$-ZZZ-$N_a$-$n_q$3'

3'$n_p$'-$N_a$'-Y'Y'Y'-$N_b$'-Z'Z'Z'-$N_a$'$n_q$'5'     (IIIb)

5'$n_p$-$N_a$-XXX-$N_b$-YYY-$N_a$-$n_q$3'

3'$n_p$'-$N_a$'-X'X'X'-$N_b$'-Y'Y'Y'-$N_a$'-$n_q$'5'     (IIIc)

5'$n_p$-$N_a$-XXX-$N_b$-YYY-$N_b$-ZZZ-$N_a$-$n_q$3'

3'$n_p$'-$N_a$'-X'X'X'-$N_b$'-Y'Y'Y'-$N_b$'-Z'Z'Z'-$N_a$-$n_q$'5'     (IIId)

When the RNAi agent is represented by formula (IIIa), each $N_a$ independently represents an oligonucleotide sequence comprising 2-20, 2-15, or 2-10 modified nucleotides.

When the RNAi agent is represented by formula (IIIb), each $N_b$ independently represents an oligonucleotide sequence comprising 1-10, 1-7, 1-5 or 1-4 modified nucleotides. Each $N_a$ independently represents an oligonucleotide sequence comprising 2-20, 2-15, or 2-10 modified nucleotides.

When the RNAi agent is represented as formula (IIIc), each $N_b$, $N_b$' independently represents an oligonucleotide sequence comprising 0-10, 0-7, 0-10, 0-7, 0-5, 0-4, 0-2 or 0 modified nucleotides. Each $N_a$ independently represents an oligonucleotide sequence comprising 2-20, 2-15, or 2-10 modified nucleotides.

When the RNAi agent is represented as formula (IIId), each $N_b$, $N_b$' independently represents an oligonucleotide sequence comprising 0-10, 0-7, 0-10, 0-7, 0-5, 0-4, 0-2 or 0 modified nucleotides. Each $N_a$, $N_a$' independently represents an oligonucleotide sequence comprising 2-20, 2-15, or 2-10 modified nucleotides. Each of $N_a$, $N_a$', $N_b$ and $N_b$' independently comprises modifications of alternating pattern.

Each of X, Y and Z in formulas (III), (IIIa), (IIIb), (IIIc), and (IIId) may be the same or different from each other.

When the RNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the RNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the RNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In one embodiment, the modification on the Y nucleotide is different than the modification on the Y' nucleotide, the modification on the Z nucleotide is different than the modification on the Z' nucleotide, and/or the modification on the X nucleotide is different than the modification on the X' nucleotide.

In one embodiment, when the RNAi agent is represented by formula (IIId), the $N_a$ modifications are 2'-O-methyl or 2'-fluoro modifications. In another embodiment, when the RNAi agent is represented by formula (IIId), the $N_a$ modifications are 2'-O-methyl or 2'-fluoro modifications and $n_p$'>0 and at least one $n_p$' is linked to a neighboring nucleotide a via phosphorothioate linkage. In yet another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more GalNAc derivatives attached through a bivalent or trivalent branched linker (described below). In another embodiment, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, when the RNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In one embodiment, the RNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, the RNAi agent is a multimer containing three, four, five, six or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two RNAi agents represented by formula (III), (IIIa), (IIIb), (IIIc), and (IIId) are linked to each other at the 5' end, and one or both of the 3' ends and are optionally conjugated to a ligand. Each of the agents can target the same gene or two different genes; or each of the agents can target same gene at two different target sites.

Various publications describe multimeric RNAi agents that can be used in the methods of the invention. Such publications include WO2007/091269, U.S. Pat. No. 7,858,769, WO2010/141511, WO2007/117686, WO2009/014887 and WO2011/031520 the entire contents of each of which are hereby incorporated herein by reference.

As described in more detail below, the RNAi agent that contains conjugations of one or more carbohydrate moieties to a RNAi agent can optimize one or more properties of the RNAi agent. In many cases, the carbohydrate moiety will be attached to a modified subunit of the RNAi agent. For example, the ribose sugar of one or more ribonucleotide subunits of a dsRNA agent can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide and polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The RNAi agents may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl and decalin; preferably, the acyclic group is selected from serinol backbone or diethanolamine backbone.

In certain specific embodiments, the RNAi agent for use in the methods of the invention is an agent selected from the group of agents listed in any one of Tables 11, 12, 31, and 32. These agents may further comprise a ligand. In one embodiment, the agent is selected from the group consisting of AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1. In another embodiment, the agent is selected from the group consisting of AD-70260.1, AD-70232.1, AD-70249.1, AD-70244.1, AD-70272.1, AD-70228.1, AD-70255.1, AD-70278.1, or AD-70295.1.

IV. iRNAs Conjugated to Ligands

Another modification of the RNA of an iRNA of the invention involves chemically linking to the RNA one or more ligands, moieties or conjugates that enhance the activity, cellular distribution or cellular uptake of the iRNA. Such moieties include but are not limited to lipid moieties such as a cholesterol moiety (Letsinger et al., *Proc. Natl. Acid. Sci. USA*, 1989, 86: 6553-6556), cholic acid (Manoharan et al., *Biorg. Med. Chem. Let.*, 1994, 4:1053-1060), a thioether, e.g., beryl-S-tritylthiol (Manoharan et al., *Ann. N.Y. Acad. Sci.*, 1992, 660:306-309; Manoharan et al., *Biorg. Med. Chem. Let.*, 1993, 3:2765-2770), a thiocholesterol (Oberhauser et al., *Nucl. Acids Res.*, 1992, 20:533-538), an aliphatic chain, e.g., dodecandiol or undecyl residues (Saison-Behmoaras et al., *EMBO J*, 1991, 10:1111-1118; Kabanov et al., *FEBS Lett.*, 1990, 259:327-330; Svinarchuk et al., *Biochimie*, 1993, 75:49-54), a phospholipid, e.g., di-hexadecyl-rac-glycerol or triethylammonium 1,2-di-O-hexadecyl-rac-glycero-3-phosphonate (Manoharan et al., *Tetrahedron Lett.*, 1995, 36:3651-3654; Shea et al., *Nucl. Acids Res.*, 1990, 18:3777-3783), a polyamine or a polyethylene glycol chain (Manoharan et al., *Nucleosides & Nucleotides*, 1995, 14:969-973), or adamantane acetic acid (Manoharan et al., *Tetrahedron Lett.*, 1995, 36:3651-3654), a palmityl moiety (Mishra et al., *Biochim. Biophys. Acta*, 1995, 1264:229-237), or an octadecylamine or hexylaminocarbonyloxycholesterol moiety (Crooke et al., *J. Pharmacol. Exp. Ther.*, 1996, 277:923-937).

In one embodiment, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands will not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-gulucoseamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic.

Other examples of ligands include dyes, intercalating agents (e.g. acridines), cross-linkers (e.g. psoralen, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated oligonucleotides of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated oligonucleotides and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In one embodiment, the ligand or conjugate is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, and/or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In a preferred embodiment, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In another preferred embodiment, the lipid based ligand binds HSA weakly or not at all, such that the conjugate will be preferably distributed to the kidney. Other moieties that target to kidney cells can also be used in place of or in addition to the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 1831). An RFGF analogue (e.g., amino acid sequence AALLPVLLAAP (SEQ ID NO: 1832) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 1833) and the *Drosophila* Antennapedia protein (RQIKIWFQNRRMKWKK (SEQ ID NO: 1834) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA oligonucleotide further comprises a carbohydrate. The carbohydrate conjugated iRNA are advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri- and oligosaccharides containing from about 4, 5, 6, 7, 8, or 9 monosaccharide units), and polysaccharides such as starches, glycogen, cellulose and polysaccharide gums. Specific monosaccharides include HDV and above (e.g., C6, C7, or C8) sugars; di- and trisaccharides include sugars having two or three monosaccharide units (e.g., C6, C7, or C8).

In one embodiment, a carbohydrate conjugate for use in the compositions and methods of the invention is a monosaccharide. In one embodiment, the monosaccharide is an N-acetylgalactosamine, such as

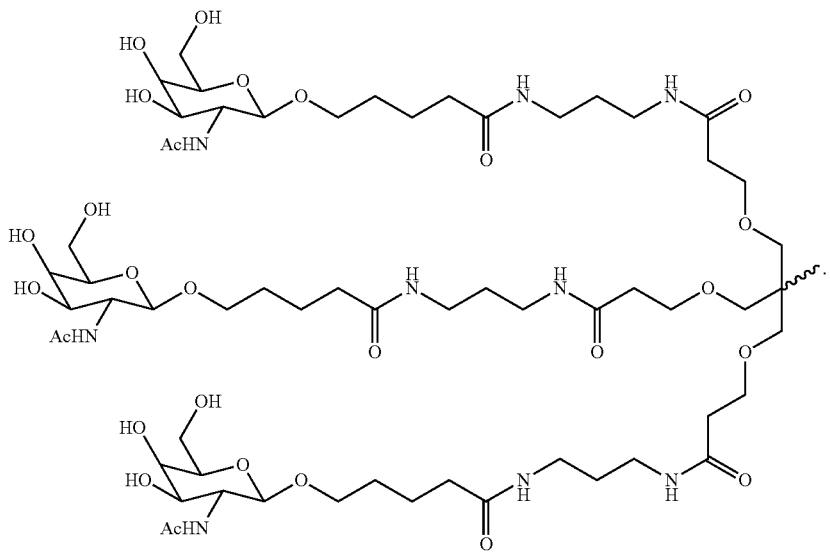 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

Formula II

In another embodiment, a carbohydrate conjugate for use in the compositions and methods of the invention is selected from the group consisting of:

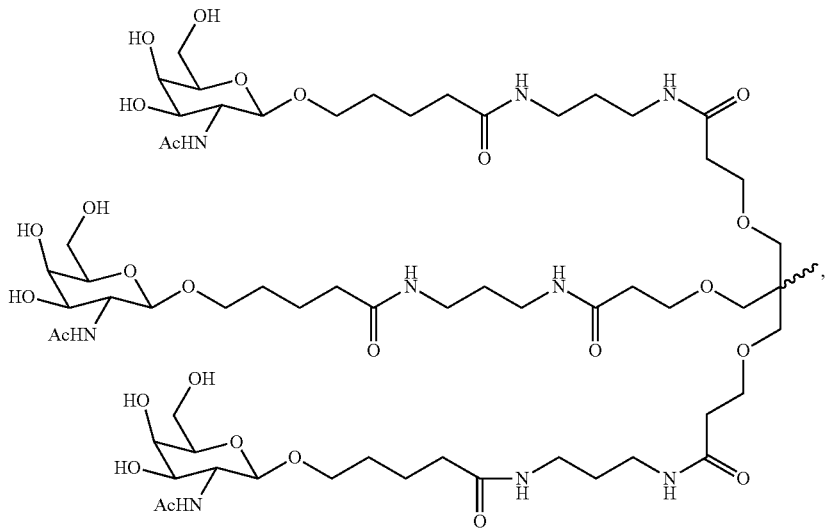

Formula II

-continued
Formula III
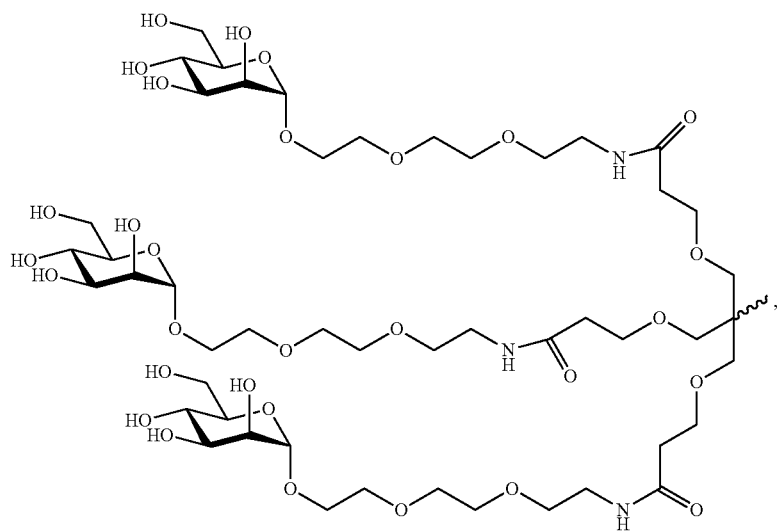
Formula IV
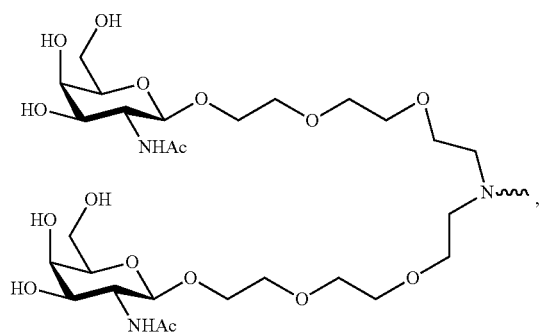
Formula V
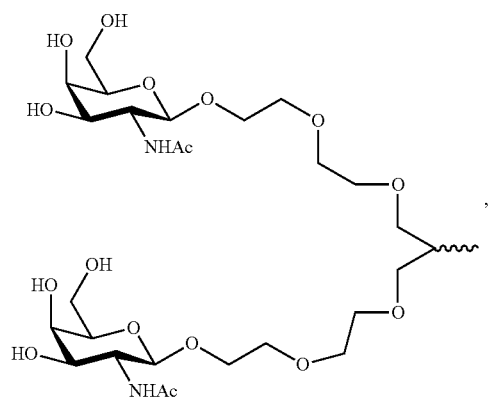
Formula VI
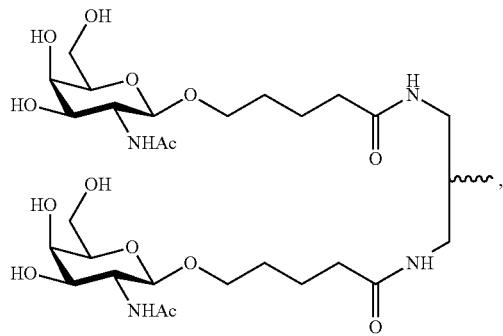
Formula VII
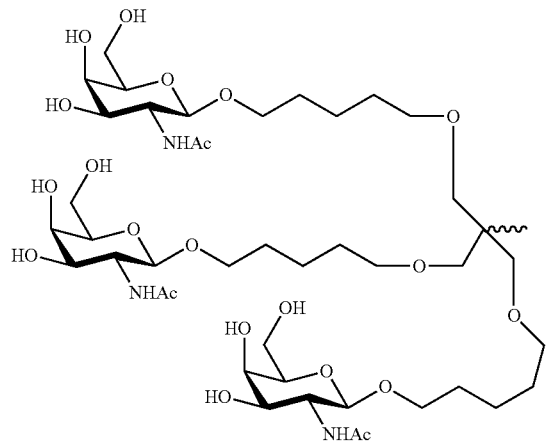

Formula VIII
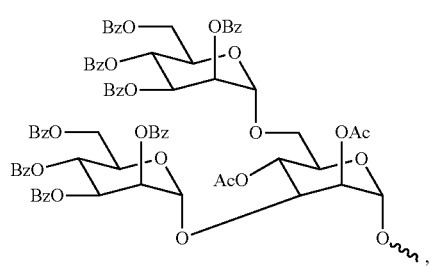
Formula IX
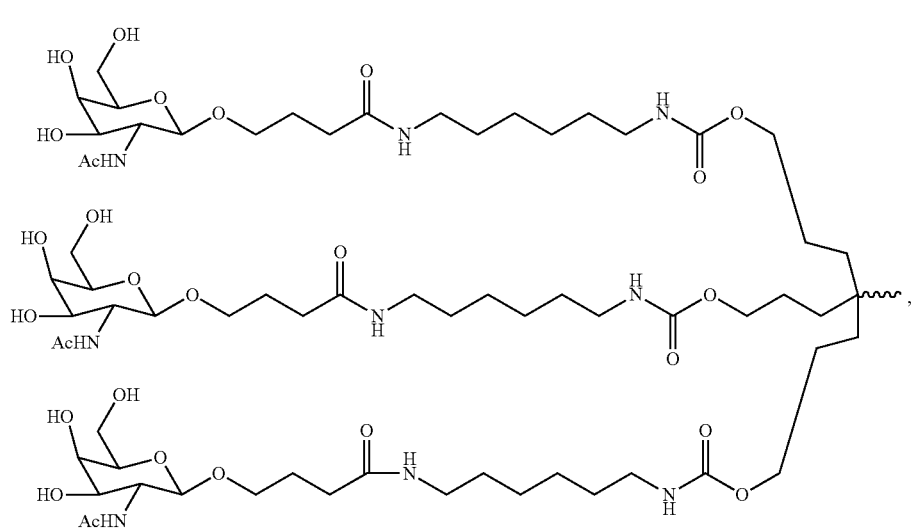
Formula X
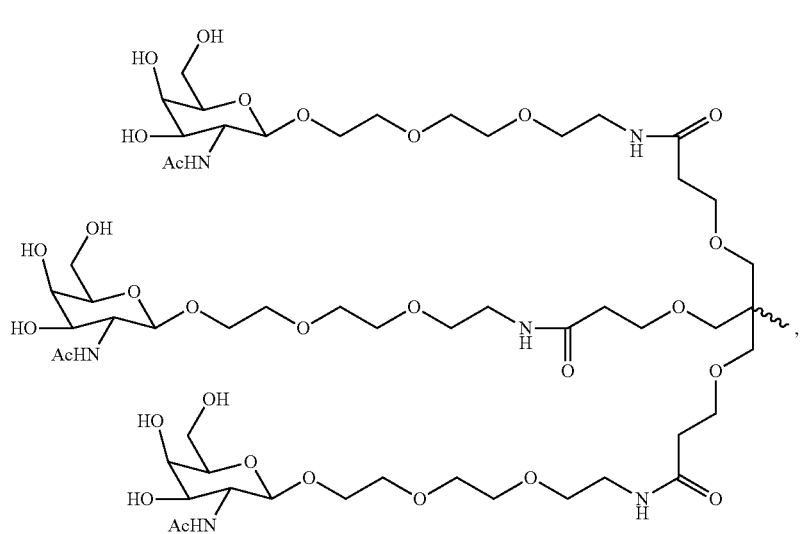

-continued
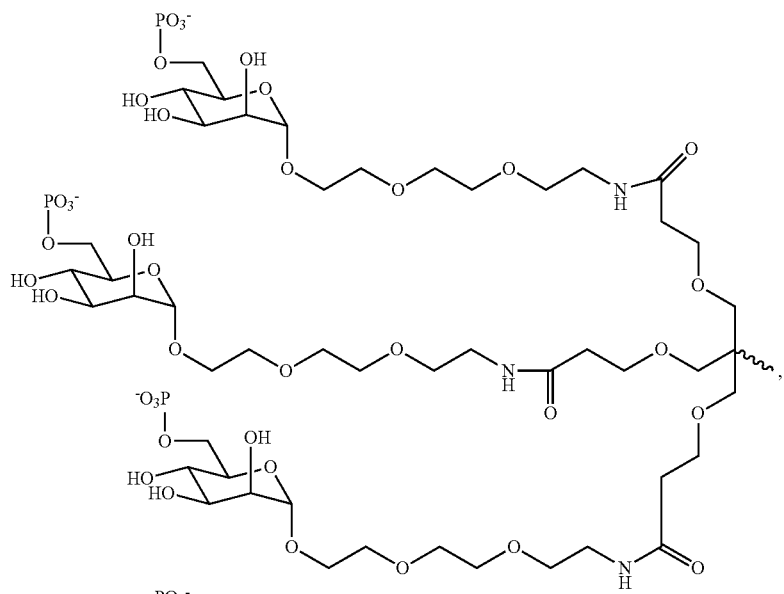
Formula XI
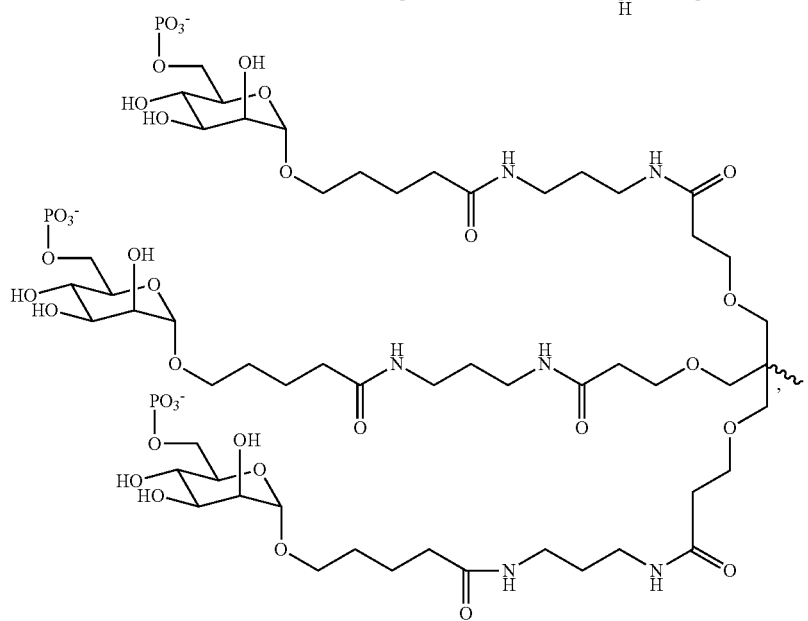
Formula XII
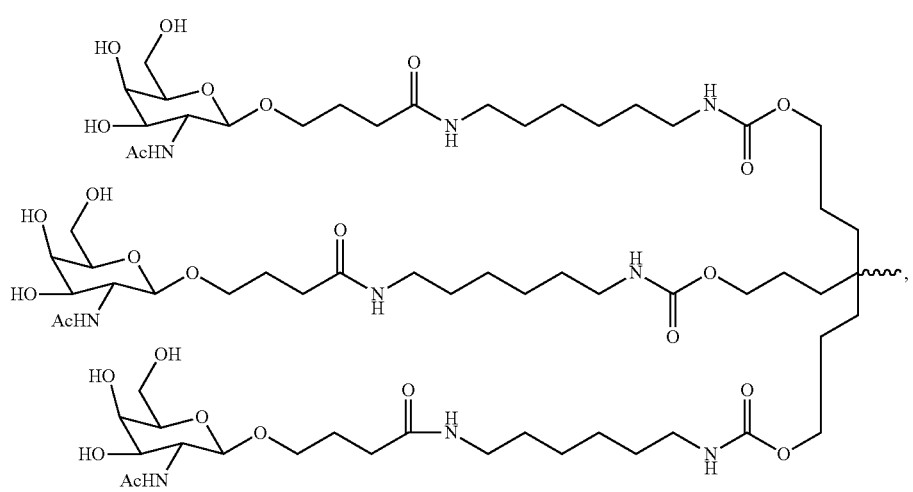
Formula XIII

Formula XIV
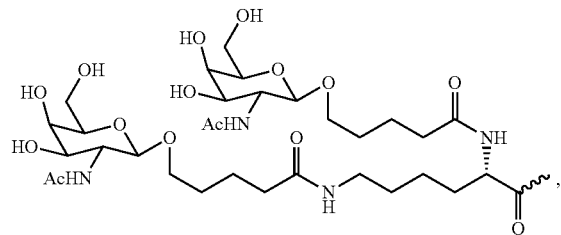
Formula XV
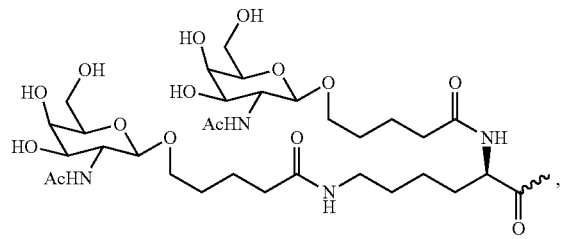
Formula XVI
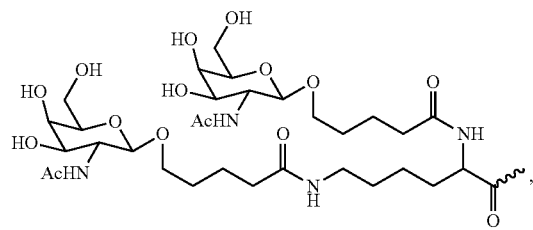
Formula XVII
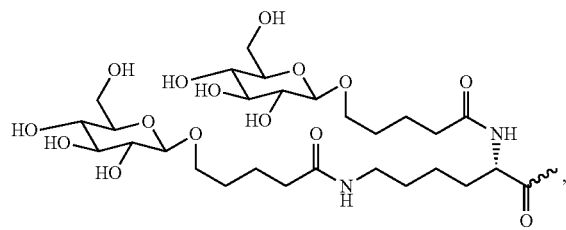
Formula XVIII
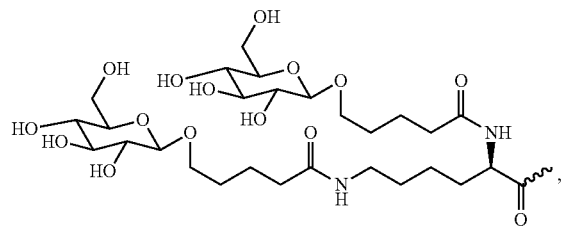
Formula XIX
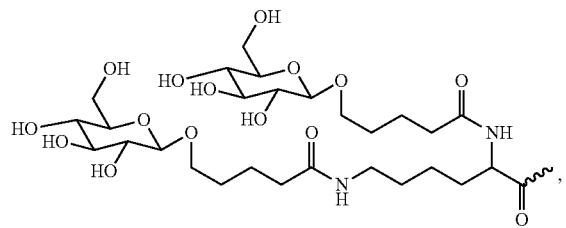
Formula XX
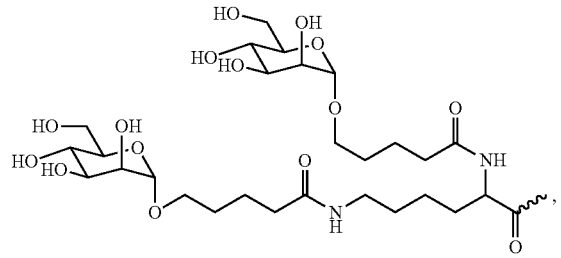
Formula XXI
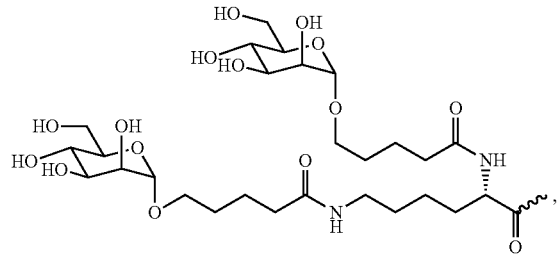
Formula XXII
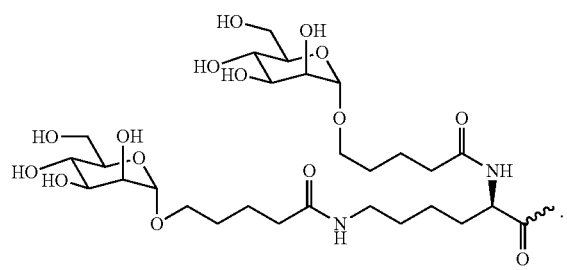

Another representative carbohydrate conjugate for use in the embodiments described herein includes, but is not limited to,

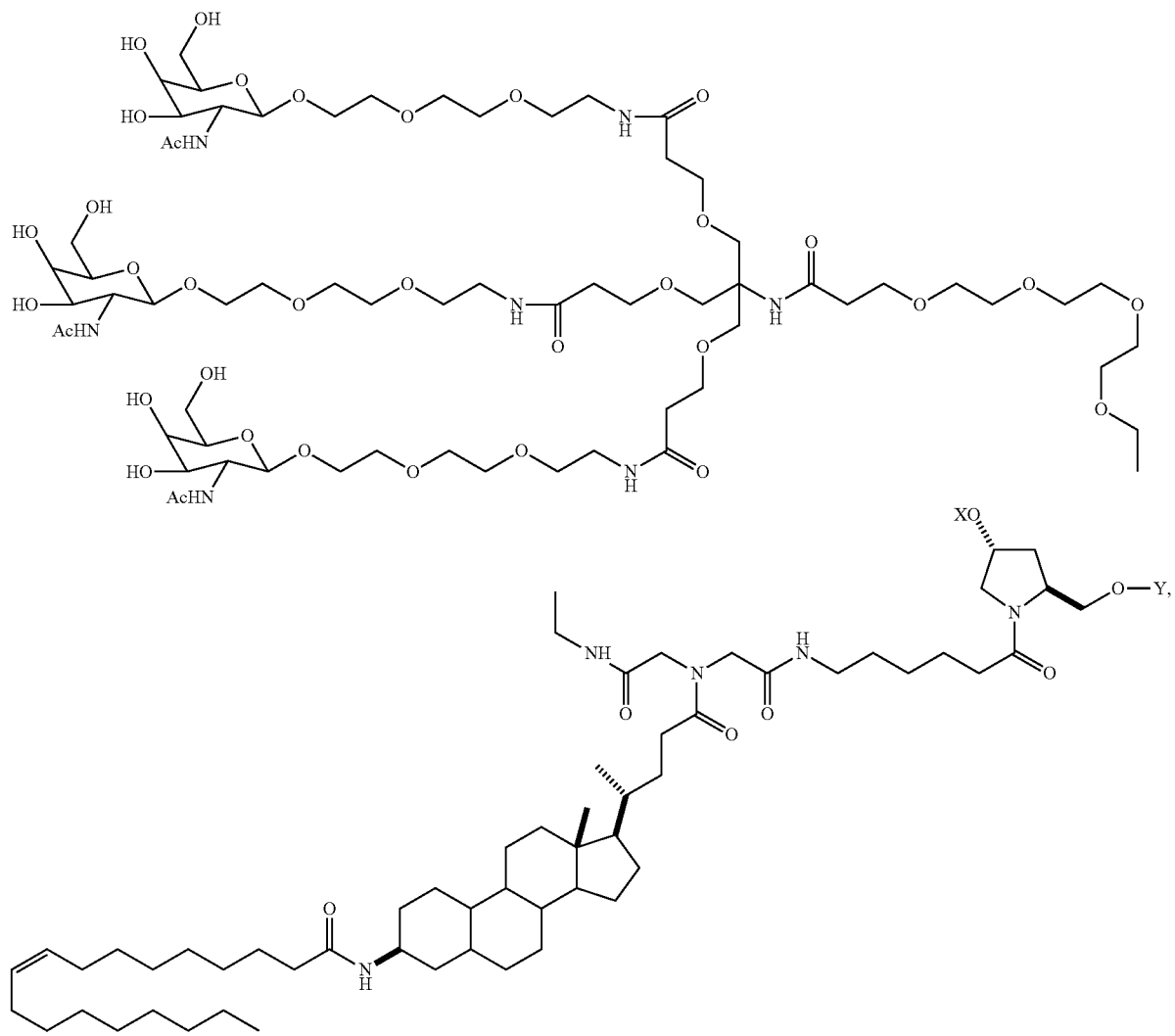

(Formula XXIII)

when one of X or Y is an oligonucleotide, the other is a hydrogen.

In some embodiments, the carbohydrate conjugate further comprises one or more additional ligands as described above, such as, but not limited to, a PK modulator and/or a cell permeation peptide.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In one embodiment, the linker is between about 1-24 atoms, 2-24, 3-24, 4-24, 5-24, 6-24, 6-18, 7-18, 8-18 atoms, 7-17, 8-17, 6-16, 7-16, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least about 2, 4, 10, 20, 30, 40, 50, 60, 70, 80, 90, or about 100 times faster in the cell (or under in vitro conditions selected to mimic intracellular conditions) as compared to blood or serum (or under in vitro conditions selected to mimic extracellular conditions).

i. Redox Cleavable Linking Groups

In one embodiment, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In another embodiment, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, —O—P(S)(H)—S—. A preferred embodiment is —O—P(O)(OH)—O—. These candidates can be evaluated using methods analogous to those described above.

iii. Acid Cleavable Linking Groups

In another embodiment, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In another embodiment, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet another embodiment, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O) NHCHRBC(O)—, where RA and RB are the R groups of the two adjacent amino acids. These candidates can be evaluated using methods analogous to those described above.

In one embodiment, an iRNA of the invention is conjugated to a carbohydrate through a linker. Non-limiting examples of iRNA carbohydrate conjugates with linkers of the compositions and methods of the invention include, but are not limited to, (Formula XXIV)

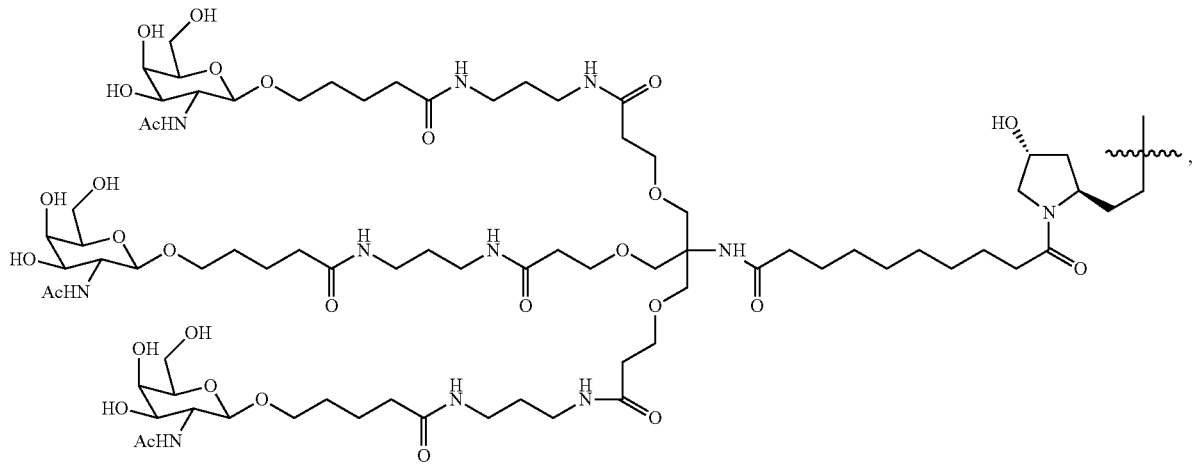

(Formula XXV)

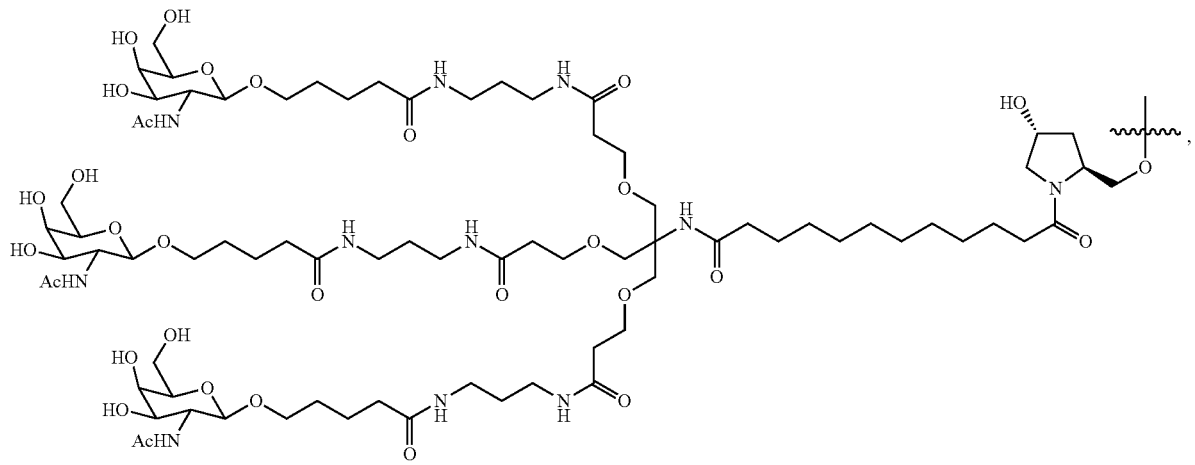

(Formula XXVI)
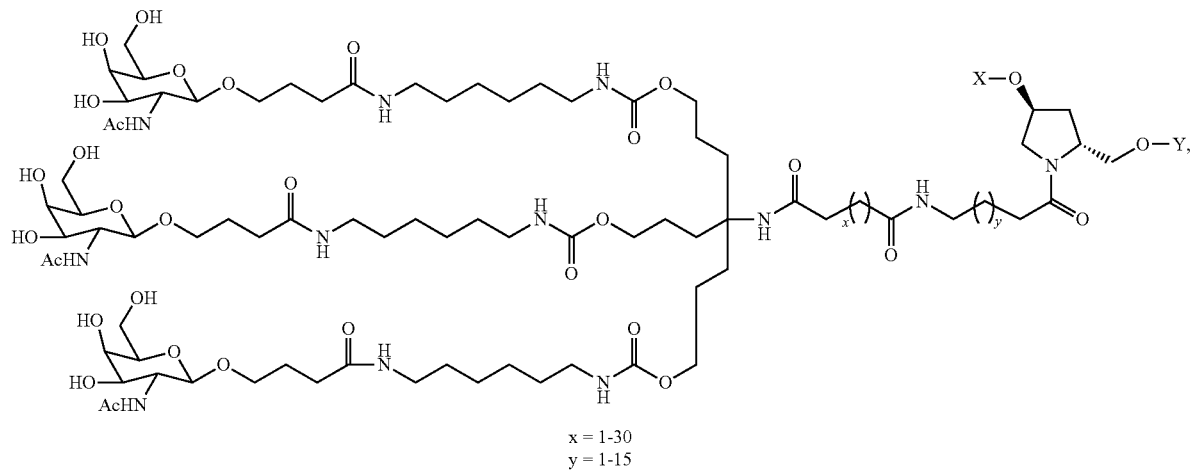
x = 1-30
y = 1-15
(Formula XXVII)
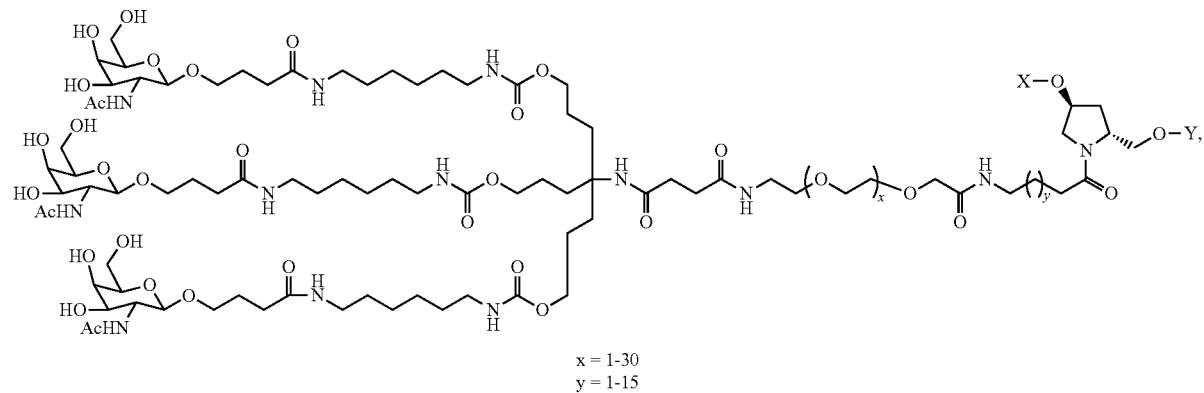
x = 1-30
y = 1-15
(Formula XXVIII)
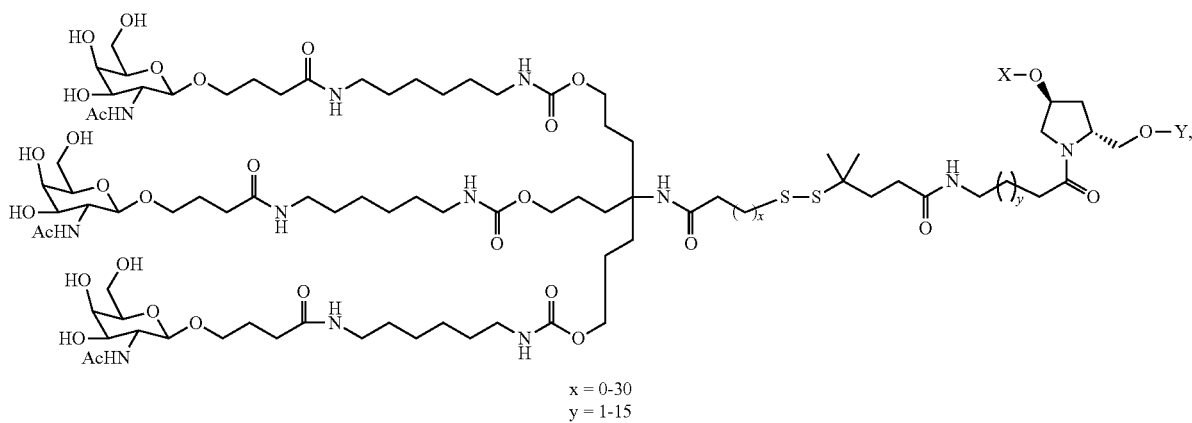
x = 0-30
y = 1-15

Formula XXIX)
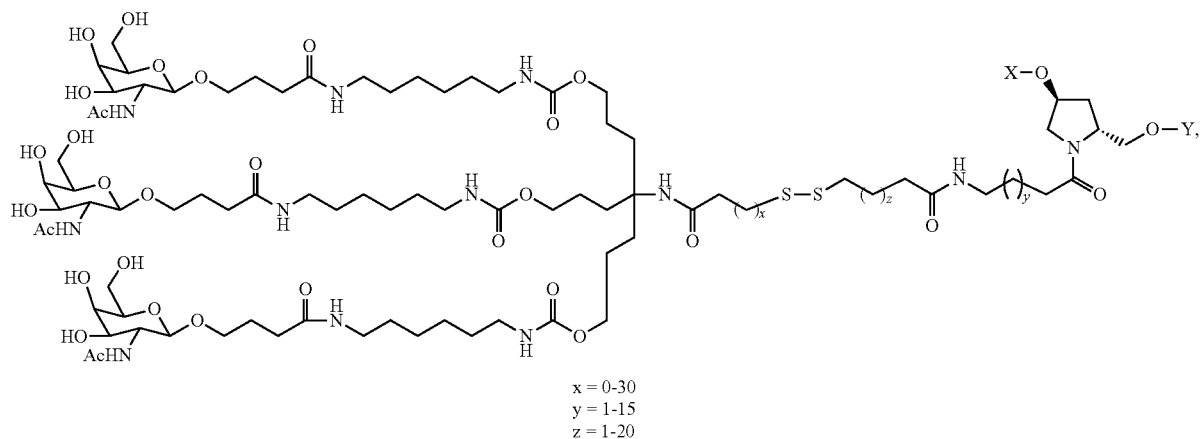
x = 0-30
y = 1-15
z = 1-20
(Formula XXX)
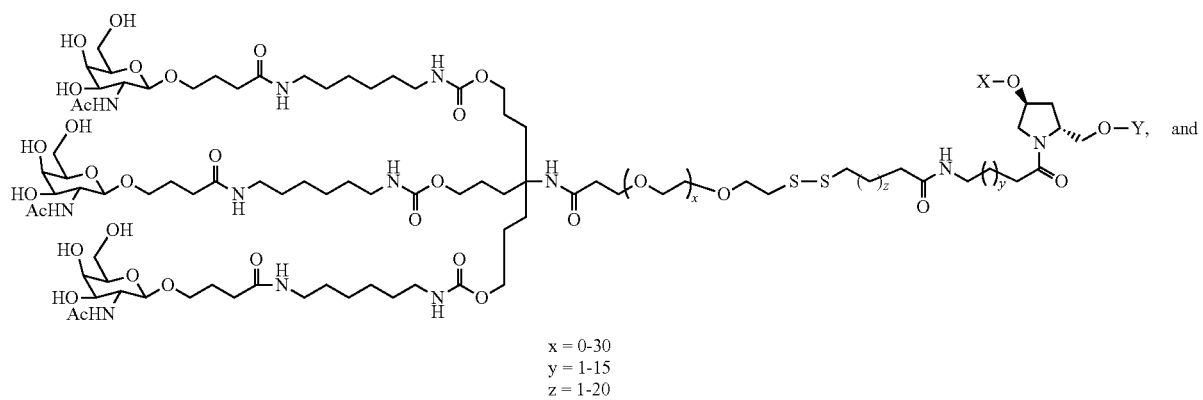
and
x = 0-30
y = 1-15
z = 1-20
(Formula XXXI)
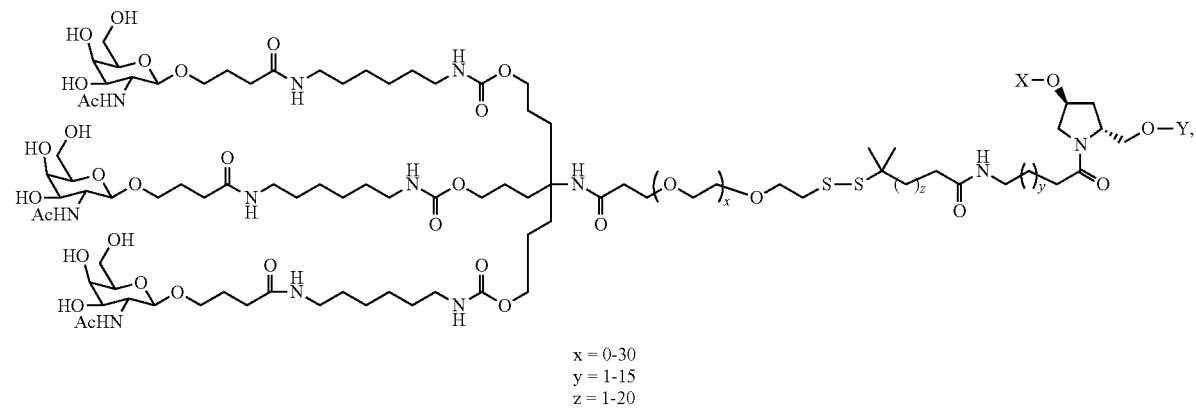
x = 0-30
y = 1-15
z = 1-20 when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In one embodiment, a dsRNA of the invention is conjugated to a bivalent or trivalent branched linker selected from the group of structures shown in any of formula (XXXII)-(XXXV):

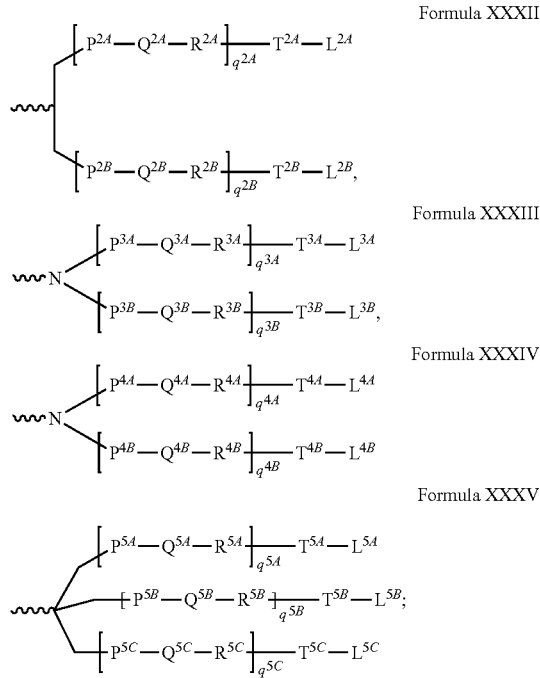

Formula XXXII

Formula XXXIII

Formula XXXIV

Formula XXXV wherein:
q2A, q2B, q3A, q3B, q4A, q4B, q5A, q5B and q5C represent independently for each occurrence 0-20 and wherein the repeating unit can be the same or different;
$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), CH$_2$, CH$_2$NH or CH$_2$O;
$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), SO$_2$, N(R$^N$), C(R')=C(R"), C≡C or C(O);
$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, CH$_2$, C(O)O, C(O)NH, NHCH(R$^a$)C(O), —C(O)—CH(R$^a$)—

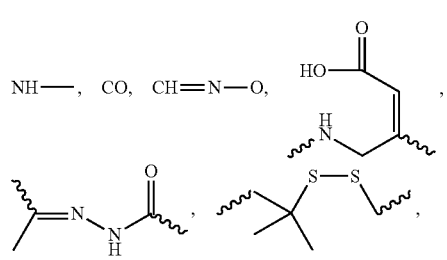

NH—, CO, CH═N—O,

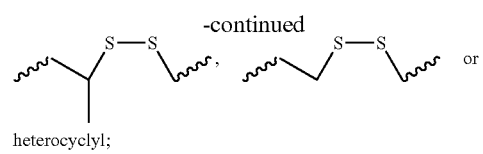

heterocyclyl;

$L^{2A}$, $L^{2B}$, $L^{3A}$, $L^{3B}$, $L^{4A}$, $L^{4B}$, $L^{5A}$, $L^{5B}$, $L^{5C}$ represent the ligand; i.e. each independently for each occurrence a monosaccharide (such as GalNAc), disaccharide, trisaccharide, tetrasaccharide, oligosaccharide, or polysaccharide; and R$^a$ is H or amino acid side chain. Trivalent conjugating GalNAc derivatives are particularly useful for use with RNAi agents for inhibiting the expression of a target gene, such as those of formula (XXXV):

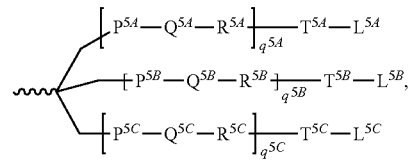

Formula XXXV wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941; 6,294,664; 6,320,017; 6,576,752; 6,783,931; 6,900,297; 7,037,646; 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNAs, which contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, and/or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.*, 2007, 365(1):54-61; Letsinger et al., *Proc. Natl. Acad. Sci. USA*, 1989, 86:6553), cholic acid (Manoharan et al., *Bioorg. Med. Chem. Lett.*, 1994, 4:1053), a thioether, e.g., hexyl-S-tritylthiol (Manoharan et al., *Ann. N.Y. Acad. Sci.*, 1992, 660:306; Manoharan et al., *Bioorg. Med. Chem. Let.*, 1993, 3:2765), a thiocholesterol (Oberhauser et al., *Nucl. Acids Res.*, 1992, 20:533), an aliphatic chain, e.g., dodecandiol or undecyl residues (Saison-Behmoaras et al., *EMBO J.*, 1991, 10:111; Kabanov et al., *FEBS Lett.*, 1990, 259:327; Svinarchuk et al., *Biochimie*, 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.*, 1995, 36:3651; Shea et al., *Nucl. Acids Res.*, 1990, 18:3777), a polyamine or a polyethylene glycol chain (Manoharan et al., *Nucleosides & Nucleotides*, 1995, 14:969), or adamantane acetic acid (Manoharan et al., *Tetrahedron Lett.*, 1995, 36:3651), a palmityl moiety (Mishra et al., *Biochim. Biophys. Acta*, 1995, 1264:229), or an octadecylamine or hexylamino-carbonyl-oxycholesterol moiety (Crooke et al., *J. Pharmacol. Exp. Ther.*, 1996, 277:923). Representative United States patents that teach the preparation of such RNA conjugates have been listed above. Typical conjugation protocols involve the synthesis of an RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

V. Delivery of an iRNA of the Invention

The delivery of an iRNA of the invention to a cell e.g., a cell within a subject, such as a human subject (e.g., a subject in need thereof, such as a subject having a disease, disorder or condition associated with HDV infection) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L. (1992) *Trends Cell. Biol.* 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. The non-specific effects of an iRNA can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the iRNA molecule to be administered. Several studies have shown successful knockdown of gene products when an iRNA is administered locally. For example, intraocular delivery of a VEGF dsRNA by intravitreal injection in cynomolgus monkeys (Tolentino, M J., et al (2004) *Retina* 24:132-138) and subretinal injections in mice (Reich, S J., et al (2003) *Mol. Vis.* 9:210-216) were both shown to prevent neovascularization in an experimental model of age-related macular degeneration. In addition, direct intratumoral injection of a dsRNA in mice reduces tumor volume (Pille, J., et al (2005) *Mol. Ther.* 11:267-274) and can prolong survival of tumor-bearing mice (Kim, W J., et al (2006) *Mol. Ther.* 14:343-350; Li, S., et al (2007) *Mol. Ther.* 15:515-523). RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J. Neurophysiol.* 93:594-602) and to the lungs by intranasal administration (Howard, K A., et al (2006) *Mol. Ther.* 14:476-484; Zhang, X., et al (2004) *J. Biol. Chem.* 279:10677-10684; Bitko, V., et al (2005) *Nat. Med.* 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA composition to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178). Conjugation of an iRNA to an aptamer has been shown to inhibit tumor growth and mediate tumor regression in a mouse model of prostate cancer (McNamara, J O., et al (2006) *Nat. Biotechnol.* 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H., et al (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R., et al (2003) *J. Mol. Biol* 327:761-766; Verma, U N., et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N., et al (2003), supra), Oligofectamine, "solid nucleic acid lipid particles" (Zimmermann, T S., et al (2006) *Nature* 441:111-114), cardiolipin (Chien, P Y., et al (2005) *Cancer Gene Ther.* 12:321-328; Pal, A., et al (2005) *Int J. Oncol.* 26:1087-1091), polyethyleneimine (Bonnet M E., et al (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A., et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector Encoded iRNAs of the Invention iRNA targeting the HDV gene can be expressed from transcription units inserted into DNA or RNA vectors (see, e.g., Couture, A, et al., *TIG.* (1996), 12:5-10; Skillern, A., et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

iRNA expression plasmids can be transfected into target cells as a complex with cationic lipid carriers (e.g., Oligofectamine) or non-cationic lipid-based carriers (e.g., Transit-TKO™). Multiple lipid transfections for iRNA-mediated knockdowns targeting different regions of a target RNA over a period of a week or more are also contemplated by the invention. Successful introduction of vectors into host cells can be monitored using various known methods. For example, transient transfection can be signaled with a reporter, such as a fluorescent marker, such as Green Fluorescent Protein (GFP). Stable transfection of cells ex vivo can be ensured using markers that provide the transfected cell with resistance to specific environmental factors (e.g., antibiotics and drugs), such as hygromycin B resistance.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are further described below.

Vectors useful for the delivery of an iRNA will include regulatory elements (promoter, enhancer, etc.) sufficient for expression of the iRNA in the desired target cell or tissue. The regulatory elements can be chosen to provide either constitutive or regulated/inducible expression.

Expression of the iRNA can be precisely regulated, for example, by using an inducible regulatory sequence that is sensitive to certain physiological regulators, e.g., circulating glucose levels, or hormones (Docherty et al., 1994, *FASEB J.* 8:20-24). Such inducible expression systems, suitable for the control of dsRNA expression in cells or in mammals include, for example, regulation by ecdysone, by estrogen, progesterone, tetracycline, chemical inducers of dimerization, and isopropyl-beta-D1-thiogalactopyranoside (IPTG). A person skilled in the art would be able to choose the appropriate regulatory/promoter sequence based on the intended use of the iRNA transgene.

Viral vectors that contain nucleic acid sequences encoding an iRNA can be used. For example, a retroviral vector can be used (see Miller et al., *Meth. Enzymol.* 217:581-599 (1993)). These retroviral vectors contain the components necessary for the correct packaging of the viral genome and integration into the host cell DNA. The nucleic acid sequences encoding an iRNA are cloned into one or more vectors, which facilitate delivery of the nucleic acid into a patient. More detail about retroviral vectors can be found, for example, in Boesen et al., *Biotherapy* 6:291-302 (1994), which describes the use of a retroviral vector to deliver the mdr1 gene to hematopoietic stem cells in order to make the stem cells more resistant to chemotherapy. Other references illustrating the use of retroviral vectors in gene therapy are: Clowes et al., *J. Clin. Invest.* 93:644-651 (1994); Kiem et al., *Blood* 83:1467-1473 (1994); Salmons and Gunzberg, *Human Gene Therapy* 4:129-141 (1993); and Grossman and Wilson, *Curr. Opin. in Genetics and Devel.* 3:110-114 (1993). Lentiviral vectors contemplated for use include, for example, the HIV based vectors described in U.S. Pat. Nos. 6,143,520; 5,665,557; and 5,981,276, which are herein incorporated by reference.

Adenoviruses are also contemplated for use in delivery of iRNAs of the invention. Adenoviruses are especially attractive vehicles, e.g., for delivering genes to respiratory epithelia. Adenoviruses naturally infect respiratory epithelia where they cause a mild disease. Other targets for adenovirus-based delivery systems are liver, the central nervous system, endothelial cells, and muscle. Adenoviruses have the advantage of being capable of infecting non-dividing cells. Kozarsky and Wilson, *Current Opinion in Genetics and Development* 3:499-503 (1993) present a review of adenovirus-based gene therapy. Bout et al., *Human Gene Therapy* 5:3-10 (1994) demonstrated the use of adenovirus vectors to transfer genes to the respiratory epithelia of rhesus monkeys. Other instances of the use of adenoviruses in gene therapy can be found in Rosenfeld et al., *Science* 252:431-434 (1991); Rosenfeld et al., *Cell* 68:143-155 (1992); Mastrangeli et al., *J. Clin. Invest.* 91:225-234 (1993); PCT Publication WO94/12649; and Wang, et al., *Gene Therapy* 2:775-783 (1995). A suitable AV vector for expressing an iRNA featured in the invention, a method for constructing the recombinant AV vector, and a method for delivering the vector into target cells, are described in Xia H et al. (2002), *Nat. Biotech.* 20: 1006-1010.

Adeno-associated virus (AAV) vectors may also be used to delivery an iRNA of the invention (Walsh et al., *Proc. Soc. Exp. Biol. Med.* 204:289-300 (1993); U.S. Pat. No. 5,436,146). In one embodiment, the iRNA can be expressed as two separate, complementary single-stranded RNA molecules from a recombinant AAV vector having, for example, either the U6 or H1 RNA promoters, or the cytomegalovirus (CMV) promoter. Suitable AAV vectors for expressing the dsRNA featured in the invention, methods for constructing the recombinant AV vector, and methods for delivering the vectors into target cells are described in Samulski R et al. (1987), *J. Virol.* 61: 3096-3101; Fisher K J et al. (1996), *J. Virol,* 70: 520-532; Samulski R et al. (1989), *J. Virol.* 63: 3822-3826; U.S. Pat. Nos. 5,252,479; 5,139,941; International Patent Application No. WO 94/13788; and International Patent Application No. WO 93/24641, the entire disclosures of which are herein incorporated by reference.

Another viral vector suitable for delivery of an iRNA of the inevtion is a pox virus such as a vaccinia virus, for example an attenuated vaccinia such as Modified Virus Ankara (MVA) or NYVAC, an avipox such as fowl pox or canary pox.

The tropism of viral vectors can be modified by pseudotyping the vectors with envelope proteins or other surface antigens from other viruses, or by substituting different viral capsid proteins, as appropriate. For example, lentiviral vectors can be pseudotyped with surface proteins from vesicular stomatitis virus (VSV), rabies, Ebola, Mokola, and the like. AAV vectors can be made to target different cells by engineering the vectors to express different capsid protein serotypes; see, e.g., Rabinowitz J E et al. (2002), *J Virol* 76:791-801, the entire disclosure of which is herein incorporated by reference.

The pharmaceutical preparation of a vector can include the vector in an acceptable diluent, or can include a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

VI. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for treating a disease or disorder associated with the expression or activity of an HDV gene. Such pharmaceutical compositions are formulated based on the mode of delivery. One example is compositions that are formulated for systemic administration via parenteral delivery, e.g., by subcutaneous, intramuscularly (IM), (SC) or intravenous (IV) delivery. Another example is compositions that are formulated for direct delivery into the brain parenchyma, e.g., by infusion into the brain, such as by continuous pump infusion. The pharmaceutical compositions of the invention may be administered in dosages sufficient to inhibit expression of an HDV gene.

In one embodiment, an iRNA agent of the invention is administered to a subject as a weight-based dose. A "weight-based dose" (e.g., a dose in mg/kg) is a dose of the iRNA agent that will change depending on the subject's weight. In another embodiement, an iRNA agent is administered to a subject as a fixed dose. A "fixed dose" (e.g., a dose in mg) means that one dose of an iRNA agent is used for all subjects regardless of any specific subject-related factors, such as weight. In one particular embodiment, a fixed dose of an iRNA agent of the invention is based on a predetermined weight or age.

In general, a suitable dose of an iRNA of the invention will be in the range of about 0.001 to about 200.0 milligrams per kilogram body weight of the recipient per day, generally in the range of about 1 to 50 mg per kilogram body weight per day. For example, the dsRNA can be administered at about 0.01 mg/kg, about 0.05 mg/kg, about 0.5 mg/kg, about 1 mg/kg, about 1.5 mg/kg, about 2 mg/kg, about 3 mg/kg, about 10 mg/kg, about 20 mg/kg, about 30 mg/kg, about 40 mg/kg, or about 50 mg/kg per single dose.

For example, the dsRNA may be administered at a dose of about 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, or about 10 mg/kg. Values and ranges intermediate to the recited values are also intended to be part of this invention.

In another embodiment, the dsRNA is administered at a dose of about 0.1 to about 50 mg/kg, about 0.25 to about 50 mg/kg, about 0.5 to about 50 mg/kg, about 0.75 to about 50 mg/kg, about 1 to about 50 mg/kg, about 1.5 to about 50 mg/kg, about 2 to about 50 mg/kg, about 2.5 to about 50 mg/kg, about 3 to about 50 mg/kg, about 3.5 to about 50 mg/kg, about 4 to about 50 mg/kg, about 4.5 to about 50 mg/kg, about 5 to about 50 mg/kg, about 7.5 to about 50 mg/kg, about 10 to about 50 mg/kg, about 15 to about 50 mg/kg, about 20 to about 50 mg/kg, about 20 to about 50 mg/kg, about 25 to about 50 mg/kg, about 25 to about 50 mg/kg, about 30 to about 50 mg/kg, about 35 to about 50 mg/kg, about 40 to about 50 mg/kg, about 45 to about 50 mg/kg, about 0.1 to about 45 mg/kg, about 0.25 to about 45 mg/kg, about 0.5 to about 45 mg/kg, about 0.75 to about 45 mg/kg, about 1 to about 45 mg/kg, about 1.5 to about 45 mg/kg, about 2 to about 45 mg/kg, about 2.5 to about 45 mg/kg, about 3 to about 45 mg/kg, about 3.5 to about 45 mg/kg, about 4 to about 45 mg/kg, about 4.5 to about 45 mg/kg, about 5 to about 45 mg/kg, about 7.5 to about 45 mg/kg, about 10 to about 45 mg/kg, about 15 to about 45 mg/kg, about 20 to about 45 mg/kg, about 20 to about 45 mg/kg, about 25 to about 45 mg/kg, about 25 to about 45 mg/kg, about 30 to about 45 mg/kg, about 35 to about 45 mg/kg, about 40 to about 45 mg/kg, about 0.1 to about 40 mg/kg, about 0.25 to about 40 mg/kg, about 0.5 to about 40 mg/kg, about 0.75 to about 40 mg/kg, about 1 to about 40 mg/kg, about 1.5 to about 40 mg/kg, about 2 to about 40 mg/kg, about 2.5 to about 40 mg/kg, about 3 to about 40 mg/kg, about 3.5 to about 40 mg/kg, about 4 to about 40 mg/kg, about 4.5 to about 40 mg/kg, about 5 to about 40 mg/kg, about 7.5 to about 40 mg/kg, about 10 to about 40 mg/kg, about 15 to about 40 mg/kg, about 20 to about 40 mg/kg, about 20 to about 40 mg/kg, about 25 to about 40 mg/kg, about 25 to about 40 mg/kg, about 30 to about 40 mg/kg, about 35 to about 40 mg/kg, about 0.1 to about 30 mg/kg, about 0.25 to about 30 mg/kg, about 0.5 to about 30 mg/kg, about 0.75 to about 30 mg/kg, about 1 to about 30 mg/kg, about 1.5 to about 30 mg/kg, about 2 to about 30 mg/kg, about 2.5 to about 30 mg/kg, about 3 to about 30 mg/kg, about 3.5 to about 30 mg/kg, about 4 to about 30 mg/kg, about 4.5 to about 30 mg/kg, about 5 to about 30 mg/kg, about 7.5 to about 30 mg/kg, about 10 to about 30 mg/kg, about 15 to about 30 mg/kg, about 20 to about 30 mg/kg, about 20 to about 30 mg/kg, about 25 to about 30 mg/kg, about 0.1 to about 20 mg/kg, about 0.25 to about 20 mg/kg, about 0.5 to about 20 mg/kg, about 0.75 to about 20 mg/kg, about 1 to about 20 mg/kg, about 1.5 to about 20 mg/kg, about 2 to about 20 mg/kg, about 2.5 to about 20 mg/kg, about 3 to about 20 mg/kg, about 3.5 to about 20 mg/kg, about 4 to about 20 mg/kg, about 4.5 to about 20 mg/kg, about 5 to about 20 mg/kg, about 7.5 to about 20 mg/kg, about 10 to about 20 mg/kg, or about 15 to about 20 mg/kg. In one embodiment, the dsRNA is administered at a dose of about 10 mg/kg to about 30 mg/kg. Values and ranges intermediate to the recited values are also intended to be part of this invention.

For example, subjects can be administered, e.g., subcutaneously, intramuscularly, or intravenously, a single therapeutic amount of iRNA, such as about 0.1, 0.125, 0.15, 0.175, 0.2, 0.225, 0.25, 0.275, 0.3, 0.325, 0.35, 0.375, 0.4, 0.425, 0.45, 0.475, 0.5, 0.525, 0.55, 0.575, 0.6, 0.625, 0.65, 0.675, 0.7, 0.725, 0.75, 0.775, 0.8, 0.825, 0.85, 0.875, 0.9, 0.925, 0.95, 0.975, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, 10, 10.5, 11, 11.5, 12, 12.5, 13, 13.5, 14, 14.5, 15, 15.5, 16, 16.5, 17, 17.5, 18, 18.5, 19, 19.5, 20, 20.5, 21, 21.5, 22, 22.5, 23, 23.5, 24, 24.5, 25, 25.5, 26, 26.5, 27, 27.5, 28, 28.5, 29, 29.5, 30, 31, 32, 33, 34, 34, 35, 36, 37, 38, 39, 40, 41, 42, 43, 44, 45, 46, 47, 48, 49, or about 50 mg/kg. Values and ranges intermediate to the recited values are also intended to be part of this invention.

In some embodiments, subjects are administered, e.g., subcutaneously, intramuscularly, or intravenously, multiple doses of a therapeutic amount of iRNA, such as a dose about 0.1, 0.125, 0.15, 0.175, 0.2, 0.225, 0.25, 0.275, 0.3, 0.325, 0.35, 0.375, 0.4, 0.425, 0.45, 0.475, 0.5, 0.525, 0.55, 0.575, 0.6, 0.625, 0.65, 0.675, 0.7, 0.725, 0.75, 0.775, 0.8, 0.825, 0.85, 0.875, 0.9, 0.925, 0.95, 0.975, 1, 1.1, 1.2, 1.3, 1.4, 1.5, For example, the dsRNA may be administered at a dose of about 0.01, 0.02, 0.03, 0.04, 0.05, 0.06, 0.07, 0.08, 0.09, 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, or about 10 mg/kg. Values and ranges intermediate to the recited values are also intended to be part of this invention.

In another embodiment, the dsRNA is administered at a dose of about 0.5 to about 50 mg/kg, about 0.75 to about 50 mg/kg, about 1 to about 50 mg/kg, about 1.5 to about 50 mg/kg, about 2 to about 50 mg/kg, about 2.5 to about 50 mg/kg, about 3 to about 50 mg/kg, about 3.5 to about 50 mg/kg, about 4 to about 50 mg/kg, about 4.5 to about 50 mg/kg, about 5 to about 50 mg/kg, about 7.5 to about 50 mg/kg, about 10 to about 50 mg/kg, about 15 to about 50 mg/kg, about 20 to about 50 mg/kg, about 20 to about 50 mg/kg, about 25 to about 50 mg/kg, about 25 to about 50 mg/kg, about 30 to about 50 mg/kg, about 35 to about 50

1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, 10, 10.5, 11, 11.5, 12, 12.5, 13, 13.5, 14, 14.5, 15, 15.5, 16, 16.5, 17, 17.5, 18, 18.5, 19, 19.5, 20, 20.5, 21, 21.5, 22, 22.5, 23, 23.5, 24, 24.5, 25, 25.5, 26, 26.5, 27, 27.5, 28, 28.5, 29, 29.5, 30, 31, 32, 33, 34, 34, 35, 36, 37, 38, 39, 40, 41, 42, 43, 44, 45, 46, 47, 48, 49, or about 50 mg/kg. A multi-dose regimen may include administration of a therapeutic amount of iRNA daily, such as for two days, three days, four days, five days, six days, seven days, or longer.

In other embodiments, subjects are administered, e.g., subcutaneously, intramuscularly, or intravenously, a repeat dose of a therapeutic amount of iRNA, such as a dose about 0.1, 0.125, 0.15, 0.175, 0.2, 0.225, 0.25, 0.275, 0.3, 0.325, 0.35, 0.375, 0.4, 0.425, 0.45, 0.475, 0.5, 0.525, 0.55, 0.575, 0.6, 0.625, 0.65, 0.675, 0.7, 0.725, 0.75, 0.775, 0.8, 0.825, 0.85, 0.875, 0.9, 0.925, 0.95, 0.975, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, 10, 10.5, 11, 11.5, 12, 12.5, 13, 13.5, 14, 14.5, 15, 15.5, 16, 16.5, 17, 17.5, 18, 18.5, 19, 19.5, 20, 20.5, 21, 21.5, 22, 22.5, 23, 23.5, 24, 24.5, 25, 25.5, 26, 26.5, 27, 27.5, 28, 28.5, 29, 29.5, 30, 31, 32, 33, 34, 34, 35, 36, 37, 38, 39, 40, 41, 42, 43, 44, 45, 46, 47, 48, 49, or about 50 mg/kg. A repeat-dose regimen may include administration of a therapeutic amount of iRNA on a regular basis, such as every other day, every third day, every fourth day, twice a week, once a week, every other week, or once a month.

In certain embodiments, for example, when a composition of the invention comprises a dsRNA as described herein and a lipid, subjects can be administered a therapeutic amount of iRNA, such as about 0.01 mg/kg to about 5 mg/kg, about 0.01 mg/kg to about 10 mg/kg, about 0.05 mg/kg to about 5 mg/kg, about 0.05 mg/kg to about 10 mg/kg, about 0.1 mg/kg to about 5 mg/kg, about 0.1 mg/kg to about 10 mg/kg, about 0.2 mg/kg to about 5 mg/kg, about 0.2 mg/kg to about 10 mg/kg, about 0.3 mg/kg to about 5 mg/kg, about 0.3 mg/kg to about 10 mg/kg, about 0.4 mg/kg to about 5 mg/kg, about 0.4 mg/kg to about 10 mg/kg, about 0.5 mg/kg to about 5 mg/kg, about 0.5 mg/kg to about 10 mg/kg, about 1 mg/kg to about 5 mg/kg, about 1 mg/kg to about 10 mg/kg, about 1.5 mg/kg to about 5 mg/kg, about 1.5 mg/kg to about 10 mg/kg, about 2 mg/kg to about 2.5 mg/kg, about 2 mg/kg to about 10 mg/kg, about 3 mg/kg to about 5 mg/kg, about 3 mg/kg to about 10 mg/kg, about 3.5 mg/kg to about 5 mg/kg, about 4 mg/kg to about 5 mg/kg, about 4.5 mg/kg to about 5 mg/kg, about 4 mg/kg to about 10 mg/kg, about 4.5 mg/kg to about 10 mg/kg, about 5 mg/kg to about 10 mg/kg, about 5.5 mg/kg to about 10 mg/kg, about 6 mg/kg to about 10 mg/kg, about 6.5 mg/kg to about 10 mg/kg, about 7 mg/kg to about 10 mg/kg, about 7.5 mg/kg to about 10 mg/kg, about 8 mg/kg to about 10 mg/kg, about 8.5 mg/kg to about 10 mg/kg, about 9 mg/kg to about 10 mg/kg, or about 9.5 mg/kg to about 10 mg/kg. Values and ranges intermediate to the recited values are also intended to be part of this invention.

For example, the dsRNA may be administered at a dose of about 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, or about 10 mg/kg. Values and ranges intermediate to the recited values are also intended to be part of this invention.

In certain embodiments of the invention, for example, when a double-stranded RNAi agent includes a modification (e.g., one or more motifs of three identical modifications on three consecutive nucleotides), including one such motif at or near the cleavage site of the agent, six phosphorothioate linkages, and a ligand, such an agent is administered at a dose of about 0.01 to about 0.5 mg/kg, about 0.01 to about 0.4 mg/kg, about 0.01 to about 0.3 mg/kg, about 0.01 to about 0.2 mg/kg, about 0.01 to about 0.1 mg/kg, about 0.01 mg/kg to about 0.09 mg/kg, about 0.01 mg/kg to about 0.08 mg/kg, about 0.01 mg/kg to about 0.07 mg/kg, about 0.01 mg/kg to about 0.06 mg/kg, about 0.01 mg/kg to about 0.05 mg/kg, about 0.02 to about 0.5 mg/kg, about 0.02 to about 0.4 mg/kg, about 0.02 to about 0.3 mg/kg, about 0.02 to about 0.2 mg/kg, about 0.02 to about 0.1 mg/kg, about 0.02 mg/kg to about 0.09 mg/kg, about 0.02 mg/kg to about 0.08 mg/kg, about 0.02 mg/kg to about 0.07 mg/kg, about 0.02 mg/kg to about 0.06 mg/kg, about 0.02 mg/kg to about 0.05 mg/kg, about 0.03 to about 0.5 mg/kg, about 0.03 to about 0.4 mg/kg, about 0.03 to about 0.3 mg/kg, about 0.03 to about 0.2 mg/kg, about 0.03 to about 0.1 mg/kg, about 0.03 mg/kg to about 0.09 mg/kg, about 0.03 mg/kg to about 0.08 mg/kg, about 0.03 mg/kg to about 0.07 mg/kg, about 0.03 mg/kg to about 0.06 mg/kg, about 0.03 mg/kg to about 0.05 mg/kg, about 0.04 to about 0.5 mg/kg, about 0.04 to about 0.4 mg/kg, about 0.04 to about 0.3 mg/kg, about 0.04 to about 0.2 mg/kg, about 0.04 to about 0.1 mg/kg, about 0.04 mg/kg to about 0.09 mg/kg, about 0.04 mg/kg to about 0.08 mg/kg, about 0.04 mg/kg to about 0.07 mg/kg, about 0.04 mg/kg to about 0.06 mg/kg, about 0.05 to about 0.5 mg/kg, about 0.05 to about 0.4 mg/kg, about 0.05 to about 0.3 mg/kg, about 0.05 to about 0.2 mg/kg, about 0.05 to about 0.1 mg/kg, about 0.05 mg/kg to about 0.09 mg/kg, about 0.05 mg/kg to about 0.08 mg/kg, or about 0.05 mg/kg to about 0.07 mg/kg. Values and ranges intermediate to the foregoing recited values are also intended to be part of this invention, e.g., the RNAi agent may be administered to the subject at a dose of about 0.015 mg/kg to about 0.45 mg/kg.

For example, the RNAi agent, e.g., RNAi agent in a pharmaceutical composition, may be administered at a dose of about 0.01 mg/kg, 0.0125 mg/kg, 0.015 mg/kg, 0.0175 mg/kg, 0.02 mg/kg, 0.0225 mg/kg, 0.025 mg/kg, 0.0275 mg/kg, 0.03 mg/kg, 0.0325 mg/kg, 0.035 mg/kg, 0.0375 mg/kg, 0.04 mg/kg, 0.0425 mg/kg, 0.045 mg/kg, 0.0475 mg/kg, 0.05 mg/kg, 0.0525 mg/kg, 0.055 mg/kg, 0.0575 mg/kg, 0.06 mg/kg, 0.0625 mg/kg, 0.065 mg/kg, 0.0675 mg/kg, 0.07 mg/kg, 0.0725 mg/kg, 0.075 mg/kg, 0.0775 mg/kg, 0.08 mg/kg, 0.0825 mg/kg, 0.085 mg/kg, 0.0875 mg/kg, 0.09 mg/kg, 0.0925 mg/kg, 0.095 mg/kg, 0.0975 mg/kg, 0.1 mg/kg, 0.125 mg/kg, 0.15 mg/kg, 0.175 mg/kg, 0.2 mg/kg, 0.225 mg/kg, 0.25 mg/kg, 0.275 mg/kg, 0.3 mg/kg, 0.325 mg/kg, 0.35 mg/kg, 0.375 mg/kg, 0.4 mg/kg, 0.425 mg/kg, 0.45 mg/kg, 0.475 mg/kg, or about 0.5 mg/kg. Values intermediate to the foregoing recited values are also intended to be part of this invention.

In some embodiments, the RNAi agent is administered as a fixed dose of between about 100 mg to about 900 mg, e.g., between about 100 mg to about 850 mg, between about 100 mg to about 800 mg, between about 100 mg to about 750 mg, between about 100 mg to about 700 mg, between about 100 mg to about 650 mg, between about 100 mg to about 600 mg, between about 100 mg to about 550 mg, between about 100 mg to about 500 mg, between about 200 mg to about 850 mg, between about 200 mg to about 800 mg, between about 200 mg to about 750 mg, between about 200 mg to about 700 mg, between about 200 mg to about 650 mg, between about 200 mg to about 600 mg, between about 200 mg to about 550 mg, between about 200 mg to about 500 mg, between about 300 mg to about 850 mg, between about 300 mg to about 800 mg, between about 300 mg to about 750 mg, between about 300 mg to about 700 mg, between about 300 mg to about 650 mg, between about 300 mg to about 600 mg, between about 300 mg to about 550 mg, between about 300 mg to about 500 mg, between about 400 mg to about 850 mg, between about 400 mg to about 800 mg, between about 400 mg to about 750 mg, between about 400 mg to about 700 mg, between about 400 mg to about 650 mg, between about 400 mg to about 600 mg, between about 400 mg to about 550 mg, or between about 400 mg to about 500 mg.

In some embodiments, the RNAi agent is administered as a fixed dose of about 100 mg, about 125 mg, about 150 mg, about 175 mg, 200 mg, about 225 mg, about 250 mg, about 275 mg, about 300 mg, about 325 mg, about 350 mg, about 375 mg, about 400 mg, about 425 mg, about 450 mg, about 475 mg, about 500 mg, about 525 mg, about 550 mg, about 575 mg, about 600 mg, about 625 mg, about 650 mg, about 675 mg, about 700 mg, about 725 mg, about 750 mg, about 775 mg, about 800 mg, about 825 mg, about 850 mg, about 875 mg, or about 900 mg.

The pharmaceutical composition can be administered by intravenous infusion over a period of time, such as over a 5, 6, 7, 8, 9, 10, 11, 12, 13, 14, 15, 16, 17, 18, 19, 20, and 21, 22, 23, 24, or about a 25 minute period. The administration may be repeated, for example, on a regular basis, such as weekly, biweekly (i.e., every two weeks) for one month, two months, three months, four months or longer. After an initial treatment regimen, the treatments can be administered on a less frequent basis. For example, after administration weekly or biweekly for three months, administration can be repeated once per month, for six months or a year or longer.

The pharmaceutical composition can be administered once daily, or the iRNA can be administered as two, three, or more sub-doses at appropriate intervals throughout the day or even using continuous infusion or delivery through a controlled release formulation. In that case, the iRNA contained in each sub-dose must be correspondingly smaller in order to achieve the total daily dosage. The dosage unit can also be compounded for delivery over several days, e.g., using a conventional sustained release formulation which provides sustained release of the iRNA over a several day period. Sustained release formulations are well known in the art and are particularly useful for delivery of agents at a particular site, such as could be used with the agents of the present invention. In this embodiment, the dosage unit contains a corresponding multiple of the daily dose.

In other embodiments, a single dose of the pharmaceutical compositions can be long lasting, such that subsequent doses are administered at not more than 3, 4, or 5 day intervals, or at not more than 1, 2, 3, or 4 week intervals. In some embodiments of the invention, a single dose of the pharmaceutical compositions of the invention is administered once per week. In other embodiments of the invention, a single dose of the pharmaceutical compositions of the invention is administered bi-monthly. In some embodiments of the invention, a single dose of the pharmaceutical compositions of the invention is administered once per month, once every other month, or once quarterly (i.e., every three months).

The skilled artisan will appreciate that certain factors can influence the dosage and timing required to effectively treat a subject, including but not limited to the severity of the disease or disorder, previous treatments, the general health and/or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies or on the basis of in vivo testing using an appropriate animal model, as described elsewhere herein.

The pharmaceutical compositions of the present invention can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal or intramuscular injection or infusion; subdermal, e.g., via an implanted device; or intracranial, e.g., by intraparenchymal, intrathecal or intraventricular, administration.

The iRNA can be delivered in a manner to target a particular tissue, such as the liver (e.g., the hepatocytes of the liver).

Pharmaceutical compositions and formulations for topical administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the iRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the invention can be encapsulated within liposomes or can form complexes thereto, in particular to cationic liposomes. Alternatively, iRNAs can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof). Topical formulations are described in detail in U.S. Pat. No. 6,747,014, which is incorporated herein by reference.

A. iRNA Formulations Comprising Membranous Molecular Assemblies

An iRNA for use in the compositions and methods of the invention can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the iRNA composition. The lipophilic material isolates the aqueous interior from an aqueous exterior, which typically does not include the iRNA composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the iRNA are delivered into the cell where the iRNA can specifically bind to a target RNA and can mediate iRNA. In some cases the liposomes are also specifically targeted, e.g., to direct the iRNA to particular cell types.

A liposome containing an iRNA agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The iRNA agent preparation is then added to the micelles that include the lipid component. The cationic groups on the lipid interact with the iRNA agent and condense around the iRNA agent to form a liposome. After condensation, the detergent is removed, e.g., by dialysis, to yield a liposomal preparation of iRNA agent.

If necessary a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Felgner, P. L. et al., *Proc. Natl. Acad. Sci., USA* 8:7413-7417, 1987; U.S. Pat. Nos. 4,897,355; 5,171,678; Bangham, et al. *M. Mol. Biol.* 23:238, 1965; Olson, et al. *Biochim. Biophys. Acta* 557:9, 1979; Szoka, et al. *Proc. Natl. Acad. Sci.* 75: 4194, 1978; Mayhew, et al. *Biochim. Biophys. Acta* 775:169, 1984; Kim, et al. *Biochim. Biophys. Acta* 728:339, 1983; and Fukunaga, et al. *Endocrinol.* 115:757, 1984. Commonly used techniques for preparing lipid aggregates of appropriate size for use as delivery vehicles include sonication and freeze-thaw plus extrusion (see, e.g., Mayer, et al. *Biochim. Biophys. Acta* 858:161, 1986). Microfluidization can be used when consistently small (50 to 200 nm) and relatively uniform aggregates are desired (Mayhew, et al. *Biochim. Biophys. Acta* 775:169, 1984). These methods are readily adapted to packaging iRNA agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al., *Biochem. Biophys. Res. Commun.*, 1987, 147, 980-985).

Liposomes which are pH-sensitive or negatively-charged, entrap nucleic acids rather than complex with it. Since both the nucleic acid and the lipid are similarly charged, repulsion rather than complex formation occurs. Nevertheless, some nucleic acid is entrapped within the aqueous interior of these liposomes. pH-sensitive liposomes have been used to deliver nucleic acids encoding the thymidine kinase gene to cell monolayers in culture. Expression of the exogenous gene was detected in the target cells (Zhou et al., *Journal of Controlled Release*, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of phospholipid and/or phosphatidylcholine and/or cholesterol.

Examples of other methods to introduce liposomes into cells in vitro and in vivo include U.S. Pat. Nos. 5,283,185; 5,171,678; WO 94/00569; WO 93/24640; WO 91/16024; Felgner, *J. Biol. Chem.* 269:2550, 1994; Nabel, *Proc. Natl. Acad. Sci.* 90:11307, 1993; Nabel, *Human Gene Ther.* 3:649, 1992; Gershon, *Biochem.* 32:7143, 1993; and Strauss *EMBO J.* 11:417, 1992.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al. *S.T.P. Pharma. Sci.*, 1994, 4(6) 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., *FEBS Letters*, 1987, 223, 42; Wu et al., *Cancer Research*, 1993, 53, 3765).

Various liposomes comprising one or more glycolipids are known in the art. Papahadjopoulos et al. (*Ann. N.Y. Acad. Sci.*, 1987, 507, 64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.*, 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In one embodiment, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver iRNA agents to macrophages.

Further advantages of liposomes include: liposomes obtained from natural phospholipids are biocompatible and biodegradable; liposomes can incorporate a wide range of water and lipid soluble drugs; liposomes can protect encapsulated iRNA agents in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of iRNA agent (see, e.g., Feigner, P. L. et al., Proc. Natl. Acad. Sci., USA 8:7413-7417, 1987 and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis(oleoyloxy)-3,3-(trimethylammonia)propane ("DOTAP") (Boehringer Mannheim, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wis.) and dipalmitoylphosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., Biochim. Biophys. Res. Commun. 179:280, 1991). Lipopolylysine, made by conjugating polylysine to DOPE, has been reported to be effective for transfection in the presence of serum (Zhou, X. et al., Biochim. Biophys. Acta 1065:8, 1991). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, Calif.) and Lipofectamine (DOSPA) (Life Technology, Inc., Gaithersburg, Md.). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer iRNA agent into the skin. In some implementations, liposomes are used for delivering iRNA agent to epidermal cells and also to enhance the penetration of iRNA agent into dermal tissues, e.g., into skin. For example, the liposomes can be applied topically. Topical delivery of drugs formulated as liposomes to the skin has been documented (see, e.g., Weiner et al., Journal of Drug Targeting, 1992, vol. 2, 405-410 and du Plessis et al., Antiviral Research, 18, 1992, 259-265; Mannino, R. J. and Fould-Fogerite, S., Biotechniques 6:682-690, 1988; Itani, T. et al. Gene 56:267-276. 1987; Nicolau, C. et al. Meth. Enz. 149:157-176, 1987; Straubinger, R. M. and Papahadjopoulos, D. Meth. Enz. 101:512-527, 1983; Wang, C. Y. and Huang, L., Proc. Natl. Acad. Sci. USA 84:7851-7855, 1987).

Non-ionic liposomal systems have also been examined to determine their utility in the delivery of drugs to the skin, in particular systems comprising non-ionic surfactant and cholesterol. Non-ionic liposomal formulations comprising Novasome I (glyceryl dilaurate/cholesterol/polyoxyethylene-10-stearyl ether) and Novasome II (glyceryl distearate/cholesterol/polyoxyethylene-10-stearyl ether) were used to deliver a drug into the dermis of mouse skin. Such formulations with iRNA agent are useful for treating a dermatological disorder.

Liposomes that include iRNA can be made highly deformable. Such deformability can enable the liposomes to penetrate through pore that are smaller than the average radius of the liposome. For example, transfersomes are a type of deformable liposomes.

Transferosomes can be made by adding surface edge activators, usually surfactants, to a standard liposomal composition. Transfersomes that include iRNA agent can be delivered, for example, subcutaneously by infection in order to deliver iRNA agent to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present invention are described in, for example, PCT Publication No. WO 2008/042973, the entire contents of which are incorporated herein by reference.

Transfersomes are yet another type of liposomes, and are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in "Pharmaceutical Dosage Forms", Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in "Pharmaceutical Dosage Forms", Marcel Dekker, Inc., New York, N.Y., 1988, p. 285).

The iRNA for use in the methods of the invention can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of the siRNA composition, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the siRNA composition and at least the alkali metal alkyl sulphate. The first micellar composition is then mixed with at least three micelle forming compounds to form a mixed micellar composition. In another method, the micellar composition is prepared by mixing the siRNA composition, the alkali metal alkyl sulphate and at least one of the micelle forming compounds, followed by addition of the remaining micelle forming compounds, with vigorous mixing.

Phenol and/or m-cresol may be added to the mixed micellar composition to stabilize the formulation and protect against bacterial growth. Alternatively, phenol and/or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

B. Lipid Particles iRNAs, e.g., dsRNAs of in the invention may be fully encapsulated in a lipid formulation, e.g., a LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in PCT Publication No.

WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586, 410; 6,815,432; U.S. Publication No. 2010/0324120 and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the invention.

The cationic lipid can be, for example, N,N-dioleyl-N,N-dimethylammonium chloride (DODAC), N,N-distearyl-N,N-dimethylammonium bromide (DDAB), N-(I-(2,3-dioleoyloxy)propyl)-N,N,N-trimethylammonium chloride (DOTAP), N-(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)—N,N-dimethyl-2,2-di((9Z,12Z)-octadeca-9,12-dienyetetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1), or a mixture thereof. The cationic lipid can comprise from about 20 mol % to about 50 mol % or about 40 mol % of the total lipid present in the particle.

In another embodiment, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference.

In one embodiment, the lipid-siRNA particle includes 40% 2, 2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The ionizable/non-cationic lipid can be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid can be from about 5 mol % to about 90 mol %, about 10 mol %, or about 58 mol % if cholesterol is included, of the total lipid present in the particle.

The conjugated lipid that inhibits aggregation of particles can be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate can be, for example, a PEG-dilauryloxypropyl ($Ci_2$), a PEG-dimyristyloxypropyl ($Ci_4$), a PEG-dipalmityloxypropyl ($Ci_6$), or a PEG-distearyloxypropyl ($Ci_8$). The conjugated lipid that prevents aggregation of particles can be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In one embodiment, the lipidoid ND98.4HCl (MW 1487) (see U.S. patent application Ser. No. 12/056,230, filed Mar. 26, 2008, which is incorporated herein by reference), Cholesterol (Sigma-Aldrich), and PEG-Ceramide C16 (Avanti Polar Lipids) can be used to prepare lipid-dsRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

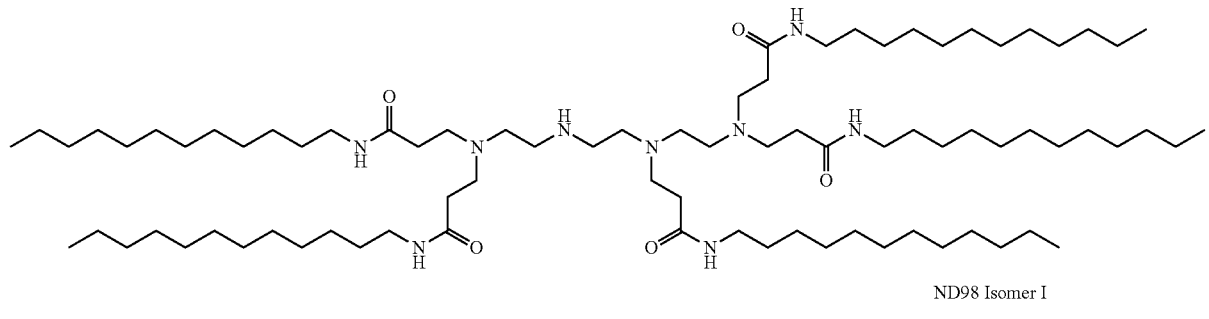

Formula 1

ND98 Isomer I

LNP01 formulations are described, e.g., in International Application Publication No. WO 2008/042973, which is hereby incorporated by reference.

Additional exemplary lipid-dsRNA formulations are described in Table 1.

TABLE 1

|  | Ionizable/Cationic Lipid | cationic lipid/non-cationic lipid/cholesterol/PEG-lipid conjugate Lipid:siRNA ratio |
|---|---|---|
| SNALP-1 | 1,2-Dilinolenyloxy-N,N-dimethylaminopropane (DLinDMA) | DLinDMA/DPPC/Cholesterol/PEG-cDMA (57.1/7.1/34.4/1.4) lipid:siRNA ~7:1 |
| 2-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA ~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA ~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA ~11:1 |
| LNP09 | 2,2-Dilinoleyl-4-dimethylaminoethyl-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |

TABLE 1-continued

| | Ionizable/Cationic Lipid | cationic lipid/non-cationic lipid/cholesterol/PEG-lipid conjugate Lipid:siRNA ratio |
|---|---|---|
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |
| LNP22 | XTC | XTC/DSPC/Chol/PEG-DSG 50/10/38.5/1.5 Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000)
SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.
XTC comprising formulations are described, e.g., in PCT Publication No. WO 2010/088537, the entire contents of which are incorporated herein by reference.
MC3 comprising formulations are described, e.g., in U.S. Publication No. 2010/0324120, filed Jun. 10, 2010, the entire contents of which are incorporated herein by reference.
ALNY-100 comprising formulations are described, e.g., PCT Publication No. WO 2010/054406, the entire contents of which are incorporated herein by reference.
C12-200 comprising formulations are described in PCT Publication No. WO 2010/129709, the entire contents of which are incorporated herein by reference.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids or binders can be desirable. In some embodiments, oral formulations are those in which dsRNAs featured in the invention are administered in conjunction with one or more penetration enhancer surfactants and chelators. Suitable surfactants include fatty acids and/or esters or salts thereof, bile acids and/or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG) and starches; polyalkylcyanoacrylates; DEAE-derivatized polyimines, pollulans, celluloses and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents and other suitable additives such as, but not limited to, penetration enhancers, carrier compounds and other pharmaceutically acceptable carriers or excipients.

Pharmaceutical compositions of the present invention include, but are not limited to, solutions, emulsions, and liposome-containing formulations. These compositions can be generated from a variety of components that include, but are not limited to, preformed liquids, self-emulsifying solids and self-emulsifying semisolids. Particularly preferred are formulations that target the liver when treating hepatic disorders such as hepatic carcinoma.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention can be formulated into any of many possible dosage forms such as, but not limited to, tablets, capsules, gel capsules, liquid syrups, soft gels, suppositories, and enemas. The compositions of the present invention can also be formulated as suspensions in aqueous, non-aqueous or mixed media. Aqueous suspensions can further contain substances which increase the viscosity of the suspension including, for example, sodium carboxymethylcellulose, sorbitol and/or dextran. The suspension can also contain stabilizers.

C. Additional Formulations i. Emulsions

The compositions of the present invention can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution in either the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral and parenteral routes and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins and high fat nutritive preparations are among the materials that have commonly been administered orally as o/w emulsions.

ii. Microemulsions

In one embodiment of the present invention, the compositions of iRNAs and nucleic acids are formulated as microemulsions. A microemulsion can be defined as a system of water, oil and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (S0750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex 300, Captex 355, Capmul MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature.

This can be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention can also contain additional components and additives such as sorbitan monostearate (Grill 3), Labrasol, and penetration enhancers to improve the properties of the formulation and to enhance the absorption of the iRNAs and nucleic acids of the present invention. Penetration enhancers used in the microemulsions of the present invention can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles

An iRNA agent of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Each of the above mentioned classes of penetration enhancers are described below in greater detail.

Surfactants (or "surface-active agents") are chemical entities which, when dissolved in an aqueous solution, reduce the surface tension of the solution or the interfacial tension between the aqueous solution and another liquid, with the result that absorption of iRNAs through the mucosa is enhanced. In addition to bile salts and fatty acids, these penetration enhancers include, for example, sodium lauryl sulfate, polyoxyethylene-9-lauryl ether and polyoxyethylene-20-cetyl ether) (see e.g., Malmsten, M. Surfactants and polymers in drug delivery, Informa Health Care, New York, N.Y., 2002; Lee et al., Critical Reviews in Therapeutic Drug Carrier Systems, 1991, p. 92); and perfluorochemical emulsions, such as FC-43. Takahashi et al., J. Pharm. Pharmacol., 1988, 40, 252).

Various fatty acids and their derivatives which act as penetration enhancers include, for example, oleic acid, lauric acid, capric acid (n-decanoic acid), myristic acid, palmitic acid, stearic acid, linoleic acid, linolenic acid, dicaprate, tricaprate, monoolein (1-monooleoyl-rac-glycerol), dilaurin, caprylic acid, arachidonic acid, glycerol 1-monocaprate, 1-dodecylazacycloheptan-2-one, acylcarnitines, acylcholines, C1-20 alkyl esters thereof (e.g., methyl, isopropyl and t-butyl), and mono- and di-glycerides thereof (i.e., oleate, laurate, caprate, myristate, palmitate, stearate, linoleate, etc.) (see e.g., Touitou, E., et al. Enhancement in Drug Delivery, CRC Press, Danvers, Mass., 2006; Lee et al., Critical Reviews in Therapeutic Drug Carrier Systems, 1991, p. 92; Muranishi, Critical Reviews in Therapeutic Drug Carrier Systems, 1990, 7, 1-33; El Hariri et al., J. Pharm. Pharmacol., 1992, 44, 651-654).

The physiological role of bile includes the facilitation of dispersion and absorption of lipids and fat-soluble vitamins (see e.g., Malmsten, M. Surfactants and polymers in drug delivery, Informa Health Care, New York, N.Y., 2002; Brunton, Chapter 38 in: Goodman & Gilman's The Pharmacological Basis of Therapeutics, 9th Ed., Hardman et al. Eds., McGraw-Hill, New York, 1996, pp. 934-935). Various natural bile salts, and their synthetic derivatives, act as penetration enhancers. Thus the term "bile salts" includes any of the naturally occurring components of bile as well as any of their synthetic derivatives. Suitable bile salts include, for example, cholic acid (or its pharmaceutically acceptable sodium salt, sodium cholate), dehydrocholic acid (sodium dehydrocholate), deoxycholic acid (sodium deoxycholate), glucholic acid (sodium glucholate), glycholic acid (sodium glycocholate), glycodeoxycholic acid (sodium glycodeoxycholate), taurocholic acid (sodium taurocholate), taurodeoxycholic acid (sodium taurodeoxycholate), chenodeoxycholic acid (sodium chenodeoxycholate), ursodeoxycholic acid (UDCA), sodium tauro-24,25-dihydro-fusidate (STDHF), sodium glycodihydrofusidate and polyoxyethylene-9-lauryl ether (POE) (see e.g., Malmsten, M. Surfactants and polymers in drug delivery, Informa Health Care, New York, N.Y., 2002; Lee et al., Critical Reviews in Therapeutic Drug Carrier Systems, 1991, page 92; Swinyard, Chapter 39 In: Remington's Pharmaceutical Sciences, 18th Ed., Gennaro, ed., Mack Publishing Co., Easton, Pa., 1990, pages 782-783; Muranishi, Critical Reviews in Therapeutic Drug Carrier Systems, 1990, 7, 1-33; Yamamoto et al., J. Pharm. Exp. Ther., 1992, 263, 25; Yamashita et al., J. Pharm. Sci., 1990, 79, 579-583).

Chelating agents, as used in connection with the present invention, can be defined as compounds that remove metallic ions from solution by forming complexes therewith, with the result that absorption of iRNAs through the mucosa is enhanced. With regards to their use as penetration enhancers in the present invention, chelating agents have the added advantage of also serving as DNase inhibitors, as most characterized DNA nucleases require a divalent metal ion for catalysis and are thus inhibited by chelating agents (Jarrett, J. Chromatogr., 1993, 618, 315-339). Suitable chelating agents include but are not limited to disodium ethylenediaminetetraacetate (EDTA), citric acid, salicylates (e.g., sodium salicylate, 5-methoxysalicylate and homovanilate), N-acyl derivatives of collagen, laureth-9 and N-amino acyl derivatives of beta-diketones (enamines)(see e.g., Katdare, A. et al., Excipient development for pharmaceutical, biotechnology, and drug delivery, CRC Press, Danvers, Mass., 2006; Lee et al., Critical Reviews in Therapeutic Drug Carrier Systems, 1991, page 92; Muranishi, Critical Reviews in Therapeutic Drug Carrier Systems, 1990, 7, 1-33; Buur et al., J. Control Rel., 1990, 14, 43-51).

As used herein, non-chelating non-surfactant penetration enhancing compounds can be defined as compounds that demonstrate insignificant activity as chelating agents or as surfactants but that nonetheless enhance absorption of iRNAs through the alimentary mucosa (see e.g., Muranishi, Critical Reviews in Therapeutic Drug Carrier Systems, 1990, 7, 1-33). This class of penetration enhancers includes, for example, unsaturated cyclic ureas, 1-alkyl- and 1-alkenylazacyclo-alkanone derivatives (Lee et al., Critical Reviews in Therapeutic Drug Carrier Systems, 1991, page 92); and non-steroidal anti-inflammatory agents such as diclofenac sodium, indomethacin and phenylbutazone (Yamashita et al., *J. Pharm. Pharmacol.*, 1987, 39, 621-626).

Agents that enhance uptake of iRNAs at the cellular level can also be added to the pharmaceutical and other compositions of the present invention. For example, cationic lipids, such as lipofectin (Junichi et al, U.S. Pat. No. 5,705,188), cationic glycerol derivatives, and polycationic molecules, such as polylysine (Lollo et al., PCT Application WO 97/30731), are also known to enhance the cellular uptake of dsRNAs. Examples of commercially available transfection reagents include, for example Lipofectamine™ (Invitrogen; Carlsbad, Calif.), Lipofectamine 2000™ (Invitrogen; Carlsbad, Calif.), 293Fectin™ (Invitrogen; Carlsbad, Calif.), Cellfectin™ (Invitrogen; Carlsbad, Calif.), DMRIE-C™ (Invitrogen; Carlsbad, Calif.), FreeStyle™ MAX (Invitrogen; Carlsbad, Calif.), Lipofectamine™ 2000 CD (Invitrogen; Carlsbad, Calif.), Lipofectamine™ (Invitrogen; Carlsbad, Calif.), iRNAMAX (Invitrogen; Carlsbad, Calif.), Oligofectamine™ (Invitrogen; Carlsbad, Calif.), Optifect™ (Invitrogen; Carlsbad, Calif.), X-tremeGENE Q2 Transfection Reagent (Roche; Grenzacherstrasse, Switzerland), DOTAP Liposomal Transfection Reagent (Grenzacherstrasse, Switzerland), DOSPER Liposomal Transfection Reagent (Grenzacherstrasse, Switzerland), or Fugene (Grenzacherstrasse, Switzerland), Transfectam® Reagent (Promega; Madison, Wis.), TransFast™ Transfection Reagent (Promega; Madison, Wis.), Tfx™-20 Reagent (Promega; Madison, Wis.), Tfx™-50 Reagent (Promega; Madison, Wis.), DreamFect™ (OZ Biosciences; Marseille, France), EcoTransfect (OZ Biosciences; Marseille, France), TransPass' D1 Transfection Reagent (New England Biolabs; Ipswich, Mass., USA), LyoVec™/LipoGen™ (Invitrogen; San Diego, Calif., USA), PerFectin Transfection Reagent (Genlantis; San Diego, Calif., USA), NeuroPORTER Transfection Reagent (Genlantis; San Diego, Calif., USA), GenePORTER Transfection reagent (Genlantis; San Diego, Calif., USA), GenePORTER 2 Transfection reagent (Genlantis; San Diego, Calif., USA), Cytofectin Transfection Reagent (Genlantis; San Diego, Calif., USA), BaculoPORTER Transfection Reagent (Genlantis; San Diego, Calif., USA), TroganPORTER™ transfection Reagent (Genlantis; San Diego, Calif., USA), RiboFect (Bioline; Taunton, Mass., USA), PlasFect (Bioline; Taunton, Mass., USA), UniFECTOR (B-Bridge International; Mountain View, Calif., USA), SureFECTOR (B-Bridge International; Mountain View, Calif., USA), or HiFect™ (B-Bridge International, Mountain View, Calif., USA), among others.

Other agents can be utilized to enhance the penetration of the administered nucleic acids, including glycols such as ethylene glycol and propylene glycol, pyrrols such as 2-pyrrol, azones, and terpenes such as limonene and menthone.

v. Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

vi. Excipients

In contrast to a carrier compound, a "pharmaceutical carrier" or "excipient" is a pharmaceutically acceptable solvent, suspending agent or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone and the like.

vii. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Aqueous suspensions can contain substances which increase the viscosity of the suspension including, for example, sodium carboxymethylcellulose, sorbitol and/or dextran. The suspension can also contain stabilizers.

In some embodiments, pharmaceutical compositions featured in the invention include (a) one or more iRNA compounds and (b) one or more agents which function by a non-iRNA mechanism and which are useful in treating an HDV infection. Examples of such agents include, but are not limited to antiviral agents aimed at suppressing or destroying HDV and/or HBV by interfering with viral replication; and immune modulators aimed at helping the human immune system mount a defence against the virus. In contrast, immune modulators, such as corticosteroids, which induce an enhanced expression of virus and viral antigens, and a suppression of T-lymphocyte function, or adenine arabinoside, acyclovir, or dideoxyinosine, are not beneficial for the treatment of chronic hepatitis B and/or chronic hepatitis D. Suitable agents are discussed in more detail below.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50 with little or no toxicity. The dosage can vary within this range depending upon the dosage form employed and the route of administration utilized. For any compound used in the methods featured in the invention, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans Levels in plasma can be measured, for example, by high performance liquid chromatography.

In addition to their administration, as discussed above, the iRNAs featured in the invention can be administered in combination with other known agents effective in treatment of pathological processes mediated by HDV expression. In any event, the administering physician can adjust the amount and timing of iRNA administration on the basis of results observed using standard measures of efficacy known in the art or described herein.

VII. Methods of the Invention

The present invention provides therapeutic and prophylactic methods which include administering to a subject having an HDV infection and/or HDV-associated disease, disorder, and/or condition, or prone to developing, an HDV-associated disease, disorder, and/or condition (e.g., CHB), compositions comprising an iRNA agent, or pharmaceutical compositions comprising an iRNA agent, or vectors comprising an iRNA of the invention.

The methods of the invention are useful for treating a subject having an HDV infection, e.g., a subject that would benefit from reduction in HDV gene expression and/or HDV replication. In one aspect, the present invention provides methods of reducing the level of Hepatis B virus ccc DNA in a subject infected with HDV. In another aspect, the present invention provides methods of reducing the level of HDV antigen, e.g., HBsAg and/or HBeAg, in a subject infected with HDV. In another aspect, the present invention provides methods of reducing the viral load of HDV in a subject infected with HDV. The present invention also provides methods of reducing the level of alanine aminotransferase (ALT) and/or aspartate aminotransferase (AST) in a subject infected with HDV. In one aspect, the present invention provides methods for increasing the level of anti-HDV antibodies in a subject infected with HDV. In another aspect, the present invention provides methods of treating a subject having an HDV infection. In one aspect, the present invention provides methods of treating a subject having an HDV-associated disease, e.g., acute hepatitis D; hepatits B virus infection, acute hepatits B, acute fulminant hepatitis D; chronic hepatitis D; liver fibrosis; end-stage liver disease; hepatocellular carcinoma. The treatment methods (and uses) of the invention include administering to the subject, e.g., a human, a therapeutically effective amount of an iRNA agent of the invention targeting an HDV gene or a pharmaceutical composition comprising an iRNA agent of the invention targeting an HDV gene or a vector of the invention comprising an iRNA agent targeting an HDV gene.

In one aspect, the invention provides methods of preventing at least one symptom in a subject having an HDV infection, In another aspect, the present invention provides uses of a therapeutically effective amount of an iRNA agent of the invention for treating a subject, e.g., a subject that would benefit from a reduction and/or inhibition of HDV gene expression.

In a further aspect, the present invention provides uses of an iRNA agent, e.g., a dsRNA, of the invention targeting an HDV gene or pharmaceutical composition comprising an iRNA agent targeting an HDV gene in the manufacture of a medicament for treating a subject, e.g., a subject that would benefit from a reduction and/or inhibition of HDV gene expression and/or HDV replication, such as a subject having a disorder that would benefit from reduction in HDV gene expression, e.g., a HDV-associated disease.

In another aspect, the invention provides uses of an iRNA, e.g., a dsRNA, of the invention for preventing at least one symptom in a subject suffering from a disorder that would benefit from a reduction and/or inhibition of HDV gene expression and/or HDV replication.

In a further aspect, the present invention provides uses of an iRNA agent of the invention in the manufacture of a medicament for preventing at least one symptom in a subject suffering from a disorder that would benefit from a reduction and/or inhibition of HDV gene expression and/or HDV replication, such as a HDV-associated disease.

In one embodiment, an iRNA agent targeting HDV is administered to a subject having an HDV infection and/or an HDV-associated disease such that the expression of one or more HDV genes, HDV antigen levels, and/or HDV viral load levels, e.g., in a cell, tissue, blood or other tissue or fluid of the subject are reduced by at least about 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 62%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more when the dsRNA agent is administered to the subject.

In one embodiment, an iRNA agent targeting HDV is administered to a subject having an HDV infection and/or an HDV-associated disease such that the level of anti-HDV antibodies, e.g., in a cell, tissue, blood or other tissue or fluid of the subject are increased by at least about 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 62%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more when the dsRNA agent is administered to the subject.

The methods and uses of the invention include administering a composition described herein such that expression of the target HDV gene is decreased, such as for about 1, 2, 3, 4 5, 6, 7, 8, 12, 16, 18, 24, 28, 32, 36, 40, 44, 48, 52, 56, 60, 64, 68, 72, 76, or about 80 hours. In one embodiment, expression of the target HDV gene is decreased for an extended duration, e.g., at least about two, three, four, five, six, seven days or more, e.g., about one week, two weeks, three weeks, or about four weeks or longer.

Administration of the dsRNA according to the methods and uses of the invention may result in a reduction of the severity, signs, symptoms, and/or markers of such diseases or disorders in a patient with an HDV infection and/or HDV-associated disease. By "reduction" in this context is meant a statistically significant decrease in such level. The reduction can be, for example, at least about 5%, 10%, 15%, 20%, 25%, 30%, 35%, 40%, 45%, 50%, 55%, 60%, 65%, 70%, 75%, 80%, 85%, 90%, 95%, or about 100%.

Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of CHB may be assessed, for example, by periodic monitoring of viral load and transaminase levels. Comparison of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of an iRNA targeting HDV or pharmaceutical composition thereof, "effective against" an HDV-associated disease indicates that administration in a clinically appropriate manner results in a beneficial effect for at least a statistically significant fraction of patients, such as improvement of symptoms, a cure, a reduction in disease, extension of life, improvement in quality of life, or other effect generally recognized as positive by medical doctors familiar with treating HDV infection and/or an HDV-associated disease and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given iRNA drug or formulation of that drug can also be judged using an experimental animal model for the given disease as known in the art. When using an experimental animal model, efficacy of treatment is evidenced when a statistically significant reduction in a marker or symptom is observed.

Subjects can be administered a therapeutic amount of iRNA, such as about 0.01 mg/kg, 0.02 mg/kg, 0.03 mg/kg, 0.04 mg/kg, 0.05 mg/kg, 0.1 mg/kg, 0.15 mg/kg, 0.2 mg/kg, 0.25 mg/kg, 0.3 mg/kg, 0.35 mg/kg, 0.4 mg/kg, 0.45 mg/kg, 0.5 mg/kg, 0.55 mg/kg, 0.6 mg/kg, 0.65 mg/kg, 0.7 mg/kg, 0.75 mg/kg, 0.8 mg/kg, 0.85 mg/kg, 0.9 mg/kg, 0.95 mg/kg, 1.0 mg/kg, 1.1 mg/kg, 1.2 mg/kg, 1.3 mg/kg, 1.4 mg/kg, 1.5 mg/kg, 1.6 mg/kg, 1.7 mg/kg, 1.8 mg/kg, 1.9 mg/kg, 2.0 mg/kg, 2.1 mg/kg, 2.2 mg/kg, 2.3 mg/kg, 2.4 mg/kg, 2.5 mg/kg dsRNA, 2.6 mg/kg dsRNA, 2.7 mg/kg dsRNA, 2.8 mg/kg dsRNA, 2.9 mg/kg dsRNA, 3.0 mg/kg dsRNA, 3.1 mg/kg dsRNA, 3.2 mg/kg dsRNA, 3.3 mg/kg dsRNA, 3.4 mg/kg dsRNA, 3.5 mg/kg dsRNA, 3.6 mg/kg dsRNA, 3.7 mg/kg dsRNA, 3.8 mg/kg dsRNA, 3.9 mg/kg dsRNA, 4.0 mg/kg dsRNA, 4.1 mg/kg dsRNA, 4.2 mg/kg dsRNA, 4.3 mg/kg dsRNA, 4.4 mg/kg dsRNA, 4.5 mg/kg dsRNA, 4.6 mg/kg dsRNA, 4.7 mg/kg dsRNA, 4.8 mg/kg dsRNA, 4.9 mg/kg dsRNA, 5.0 mg/kg dsRNA, 5.1 mg/kg dsRNA, 5.2 mg/kg dsRNA, 5.3 mg/kg dsRNA, 5.4 mg/kg dsRNA, 5.5 mg/kg dsRNA, 5.6 mg/kg dsRNA, 5.7 mg/kg dsRNA, 5.8 mg/kg dsRNA, 5.9 mg/kg dsRNA, 6.0 mg/kg dsRNA, 6.1 mg/kg dsRNA, 6.2 mg/kg dsRNA, 6.3 mg/kg dsRNA, 6.4 mg/kg dsRNA, 6.5 mg/kg dsRNA, 6.6 mg/kg dsRNA, 6.7 mg/kg dsRNA, 6.8 mg/kg dsRNA, 6.9 mg/kg dsRNA, 7.0 mg/kg dsRNA, 7.1 mg/kg dsRNA, 7.2 mg/kg dsRNA, 7.3 mg/kg dsRNA, 7.4 mg/kg dsRNA, 7.5 mg/kg dsRNA, 7.6 mg/kg dsRNA, 7.7 mg/kg dsRNA, 7.8 mg/kg dsRNA, 7.9 mg/kg dsRNA, 8.0 mg/kg dsRNA, 8.1 mg/kg dsRNA, 8.2 mg/kg dsRNA, 8.3 mg/kg dsRNA, 8.4 mg/kg dsRNA, 8.5 mg/kg dsRNA, 8.6 mg/kg dsRNA, 8.7 mg/kg dsRNA, 8.8 mg/kg dsRNA, 8.9 mg/kg dsRNA, 9.0 mg/kg dsRNA, 9.1 mg/kg dsRNA, 9.2 mg/kg dsRNA, 9.3 mg/kg dsRNA, 9.4 mg/kg dsRNA, 9.5 mg/kg dsRNA, 9.6 mg/kg dsRNA, 9.7 mg/kg dsRNA, 9.8 mg/kg dsRNA, 9.9 mg/kg dsRNA, 9.0 mg/kg dsRNA, 10 mg/kg dsRNA, 15 mg/kg dsRNA, 20 mg/kg dsRNA, 25 mg/kg dsRNA, 30 mg/kg dsRNA, 35 mg/kg dsRNA, 40 mg/kg dsRNA, 45 mg/kg dsRNA, or about 50 mg/kg dsRNA. Values and ranges intermediate to the recited values are also intended to be part of this invention.

In certain embodiments, for example, when a composition of the invention comprises a dsRNA as described herein and a lipid, subjects can be administered a therapeutic amount of iRNA, such as about 0.01 mg/kg to about 5 mg/kg, about 0.01 mg/kg to about 10 mg/kg, about 0.05 mg/kg to about 5 mg/kg, about 0.05 mg/kg to about 10 mg/kg, about 0.1 mg/kg to about 5 mg/kg, about 0.1 mg/kg to about 10 mg/kg, about 0.2 mg/kg to about 5 mg/kg, about 0.2 mg/kg to about 10 mg/kg, about 0.3 mg/kg to about 5 mg/kg, about 0.3 mg/kg to about 10 mg/kg, about 0.4 mg/kg to about 5 mg/kg, about 0.4 mg/kg to about 10 mg/kg, about 0.5 mg/kg to about 5 mg/kg, about 0.5 mg/kg to about 10 mg/kg, about 1 mg/kg to about 5 mg/kg, about 1 mg/kg to about 10 mg/kg, about 1.5 mg/kg to about 5 mg/kg, about 1.5 mg/kg to about 10 mg/kg, about 2 mg/kg to about 2.5 mg/kg, about 2 mg/kg to about 10 mg/kg, about 3 mg/kg to about 5 mg/kg, about 3 mg/kg to about 10 mg/kg, about 3.5 mg/kg to about 5 mg/kg, about 4 mg/kg to about 5 mg/kg, about 4.5 mg/kg to about 5 mg/kg, about 4 mg/kg to about 10 mg/kg, about 4.5 mg/kg to about 10 mg/kg, about 5 mg/kg to about 10 mg/kg, about 5.5 mg/kg to about 10 mg/kg, about 6 mg/kg to about 10 mg/kg, about 6.5 mg/kg to about 10 mg/kg, about 7 mg/kg to about 10 mg/kg, about 7.5 mg/kg to about 10 mg/kg, about 8 mg/kg to about 10 mg/kg, about 8.5 mg/kg to about 10 mg/kg, about 9 mg/kg to about 10 mg/kg, or about 9.5 mg/kg to about 10 mg/kg. Values and ranges intermediate to the recited values are also intended to be part of this invention.

For example, the dsRNA may be administered at a dose of about 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, or about 10 mg/kg. Values and ranges intermediate to the recited values are also intended to be part of this invention.

In other embodiments, for example, when a composition of the invention comprises a dsRNA as described herein and an N-acetylgalactosamine, subjects can be administered a therapeutic amount of iRNA, such as a dose of about 0.1 to about 50 mg/kg, about 0.25 to about 50 mg/kg, about 0.5 to about 50 mg/kg, about 0.75 to about 50 mg/kg, about 1 to about 50 mg/kg, about 1.5 to about 50 mg/kg, about 2 to about 50 mg/kg, about 2.5 to about 50 mg/kg, about 3 to about 50 mg/kg, about 3.5 to about 50 mg/kg, about 4 to about 50 mg/kg, about 4.5 to about 50 mg/kg, about 5 to about 50 mg/kg, about 7.5 to about 50 mg/kg, about 10 to about 50 mg/kg, about 15 to about 50 mg/kg, about 20 to about 50 mg/kg, about 20 to about 50 mg/kg, about 25 to about 50 mg/kg, about 25 to about 50 mg/kg, about 30 to about 50 mg/kg, about 35 to about 50 mg/kg, about 40 to about 50 mg/kg, about 45 to about 50 mg/kg, about 0.1 to about 45 mg/kg, about 0.25 to about 45 mg/kg, about 0.5 to about 45 mg/kg, about 0.75 to about 45 mg/kg, about 1 to about 45 mg/kg, about 1.5 to about 45 mg/kg, about 2 to about 45 mg/kg, about 2.5 to about 45 mg/kg, about 3 to about 45 mg/kg, about 3.5 to about 45 mg/kg, about 4 to about 45 mg/kg, about 4.5 to about 45 mg/kg, about 5 to about 45 mg/kg, about 7.5 to about 45 mg/kg, about 10 to about 45 mg/kg, about 15 to about 45 mg/kg, about 20 to about 45 mg/kg, about 20 to about 45 mg/kg, about 25 to about 45 mg/kg, about 25 to about 45 mg/kg, about 30 to about 45 mg/kg, about 35 to about 45 mg/kg, about 40 to about 45 mg/kg, about 0.1 to about 40 mg/kg, about 0.25 to about 40 mg/kg, about 0.5 to about 40 mg/kg, about 0.75 to about 40 mg/kg, about 1 to about 40 mg/kg, about 1.5 to about 40 mg/kg, about 2 to about 40 mg/kg, about 2.5 to about 40 mg/kg, about 3 to about 40 mg/kg, about 3.5 to about 40 mg/kg, about 4 to about 40 mg/kg, about 4.5 to about 40 mg/kg, about 5 to about 40 mg/kg, about 7.5 to about 40 mg/kg, about 10 to about 40 mg/kg, about 15 to about 40 mg/kg, about 20 to about 40 mg/kg, about 20 to about 40 mg/kg, about 25 to about 40 mg/kg, about 25 to about 40 mg/kg, about 30 to about 40 mg/kg, about 35 to about 40 mg/kg, about 0.1 to about 30 mg/kg, about 0.25 to about 30 mg/kg, about 0.5 to about 30 mg/kg, about 0.75 to about 30 mg/kg, about 1 to about 30 mg/kg, about 1.5 to about 30 mg/kg, about 2 to about 30 mg/kg, about 2.5 to about 30 mg/kg, about 3 to about 30 mg/kg, about 3.5 to about 30 mg/kg, about 4 to about 30 mg/kg, about 4.5 to about 30 mg/kg, about 5 to about 30 mg/kg, about 7.5 to about 30 mg/kg, about 10 to about 30 mg/kg, about 15 to about 30 mg/kg, about 20 to about 30 mg/kg, about 20 to about 30 mg/kg, about 25 to about 30 mg/kg, about 0.1 to about 20 mg/kg, about 0.25 to about 20 mg/kg, about 0.5 to about 20 mg/kg, about 0.75 to about 20 mg/kg, about 1 to about 20 mg/kg, about 1.5 to about 20 mg/kg, about 2 to about 20 mg/kg, about 2.5 to about 20 mg/kg, about 3 to about 20 mg/kg, about 3.5 to about 20 mg/kg, about 4 to about 20 mg/kg, about 4.5 to about 20 mg/kg, about 5 to about 20 mg/kg, about 7.5 to about 20 mg/kg, about 10 to about 20 mg/kg, or about 15 to about 20 mg/kg. In one embodiment, when a composition of the invention comprises a dsRNA as described herein and an N-acetylgalactosamine, subjects can be administered a therapeutic amount of about 10 to about 30 mg/kg of dsRNA. Values and ranges intermediate to the recited values are also intended to be part of this invention.

For example, subjects can be administered a therapeutic amount of iRNA, such as about 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, 10, 10.5, 11, 11.5, 12, 12.5, 13, 13.5, 14, 14.5, 15, 15.5, 16, 16.5, 17, 17.5, 18, 18.5, 19, 19.5, 20, 20.5, 21, 21.5, 22, 22.5, 23, 23.5, 24, 24.5, 25, 25.5, 26, 26.5, 27, 27.5, 28, 28.5, 29, 29.5, 30, 31, 32, 33, 34, 34, 35, 36, 37, 38, 39, 40, 41, 42, 43, 44, 45, 46, 47, 48, 49, or about 50 mg/kg. Values and ranges intermediate to the recited values are also intended to be part of this invention.

In certain embodiments of the invention, for example, when a double-stranded RNAi agent includes a modification (e.g., one or more motifs of three identical modifications on three consecutive nucleotides), including one such motif at or near the cleavage site of the agent, six phosphorothioate linkages, and a ligand, such an agent is administered at a dose of about 0.01 to about 0.5 mg/kg, about 0.01 to about 0.4 mg/kg, about 0.01 to about 0.3 mg/kg, about 0.01 to about 0.2 mg/kg, about 0.01 to about 0.1 mg/kg, about 0.01 mg/kg to about 0.09 mg/kg, about 0.01 mg/kg to about 0.08 mg/kg, about 0.01 mg/kg to about 0.07 mg/kg, about 0.01 mg/kg to about 0.06 mg/kg, about 0.01 mg/kg to about 0.05 mg/kg, about 0.02 mg/kg to about 0.5 mg/kg, about 0.02 to about 0.4 mg/kg, about 0.02 to about 0.3 mg/kg, about 0.02 to about 0.2 mg/kg, about 0.02 mg/kg to about 0.1 mg/kg, about 0.02 mg/kg to about 0.09 mg/kg, about 0.02 mg/kg to about 0.08 mg/kg, about 0.02 mg/kg to about 0.07 mg/kg, about 0.02 mg/kg to about 0.06 mg/kg, about 0.02 mg/kg to about 0.05 mg/kg, about 0.03 to about 0.5 mg/kg, about 0.03 to about 0.4 mg/kg, about 0.03 to about 0.3 mg/kg, about 0.03 to about 0.2 mg/kg, about 0.03 to about 0.1 mg/kg, about 0.03 mg/kg to about 0.09 mg/kg, about 0.03 mg/kg to about 0.08 mg/kg, about 0.03 mg/kg to about 0.07 mg/kg, about 0.03 mg/kg to about 0.06 mg/kg, about 0.03 mg/kg to about 0.05 mg/kg, about 0.04 to about 0.5 mg/kg, about 0.04 to about 0.4 mg/kg, about 0.04 to about 0.3 mg/kg, about 0.04 to about 0.2 mg/kg, about 0.04 to about 0.1 mg/kg, about 0.04 mg/kg to about 0.09 mg/kg, about 0.04 mg/kg to about 0.08 mg/kg, about 0.04 mg/kg to about 0.07 mg/kg, about 0.04 mg/kg to about 0.06 mg/kg, about 0.05 to about 0.5 mg/kg, about 0.05 to about 0.4 mg/kg, about 0.05 to about 0.3 mg/kg, about 0.05 to about 0.2 mg/kg, about 0.05 to about 0.1 mg/kg, about 0.05 mg/kg to about 0.09 mg/kg, about 0.05 mg/kg to about 0.08 mg/kg, or about 0.05 mg/kg to about 0.07 mg/kg. Values and ranges intermediate to the foregoing recited values are also intended to be part of this invention, e.g., the RNAi agent may be administered to the subject at a dose of about 0.015 mg/kg to about 0.45 mg/kg.

For example, the RNAi agent, e.g., RNAi agent in a pharmaceutical composition, may be administered at a dose of about 0.01 mg/kg, 0.0125 mg/kg, 0.015 mg/kg, 0.0175 mg/kg, 0.02 mg/kg, 0.0225 mg/kg, 0.025 mg/kg, 0.0275 mg/kg, 0.03 mg/kg, 0.0325 mg/kg, 0.035 mg/kg, 0.0375 mg/kg, 0.04 mg/kg, 0.0425 mg/kg, 0.045 mg/kg, 0.0475 mg/kg, 0.05 mg/kg, 0.0525 mg/kg, 0.055 mg/kg, 0.0575 mg/kg, 0.06 mg/kg, 0.0625 mg/kg, 0.065 mg/kg, 0.0675 mg/kg, 0.07 mg/kg, 0.0725 mg/kg, 0.075 mg/kg, 0.0775 mg/kg, 0.08 mg/kg, 0.0825 mg/kg, 0.085 mg/kg, 0.0875 mg/kg, 0.09 mg/kg, 0.0925 mg/kg, 0.095 mg/kg, 0.0975 mg/kg, 0.1 mg/kg, 0.125 mg/kg, 0.15 mg/kg, 0.175 mg/kg, 0.2 mg/kg, 0.225 mg/kg, 0.25 mg/kg, 0.275 mg/kg, 0.3 mg/kg, 0.325 mg/kg, 0.35 mg/kg, 0.375 mg/kg, 0.4 mg/kg, 0.425 mg/kg, 0.45 mg/kg, 0.475 mg/kg, or about 0.5 mg/kg. Values intermediate to the foregoing recited values are also intended to be part of this invention.

In some embodiments, the RNAi agent is administered as a fixed dose of between about 100 mg to about 900 mg, e.g., between about 100 mg to about 850 mg, between about 100 mg to about 800 mg, between about 100 mg to about 750 mg, between about 100 mg to about 700 mg, between about 100 mg to about 650 mg, between about 100 mg to about 600 mg, between about 100 mg to about 550 mg, between about 100 mg to about 500 mg, between about 200 mg to about 850 mg, between about 200 mg to about 800 mg, between about 200 mg to about 750 mg, between about 200 mg to about 700 mg, between about 200 mg to about 650 mg, between about 200 mg to about 600 mg, between about 200 mg to about 550 mg, between about 200 mg to about 500 mg, between about 300 mg to about 850 mg, between about 300 mg to about 800 mg, between about 300 mg to about 750 mg, between about 300 mg to about 700 mg, between about 300 mg to about 650 mg, between about 300 mg to about 600 mg, between about 300 mg to about 550 mg, between about 300 mg to about 500 mg, between about 400 mg to about 850 mg, between about 400 mg to about 800 mg, between about 400 mg to about 750 mg, between about 400 mg to about 700 mg, between about 400 mg to about 650 mg, between about 400 mg to about 600 mg, between about 400 mg to about 550 mg, or between about 400 mg to about 500 mg.

In some embodiments, the RNAi agent is administered as a fixed dose of about 100 mg, about 125 mg, about 150 mg, about 175 mg, 200 mg, about 225 mg, about 250 mg, about 275 mg, about 300 mg, about 325 mg, about 350 mg, about 375 mg, about 400 mg, about 425 mg, about 450 mg, about 475 mg, about 500 mg, about 525 mg, about 550 mg, about 575 mg, about 600 mg, about 625 mg, about 650 mg, about 675 mg, about 700 mg, about 725 mg, about 750 mg, about 775 mg, about 800 mg, about 825 mg, about 850 mg, about 875 mg, or about 900 mg.

The iRNA can be administered by intravenous infusion over a period of time, such as over a 5, 6, 7, 8, 9, 10, 11, 12, 13, 14, 15, 16, 17, 18, 19, 20, 21, 22, 23, 24, or about a 25 minute period. The administration may be repeated, for example, on a regular basis, such as weekly, biweekly (i.e., every two weeks) for one month, two months, three months, four months or longer. After an initial treatment regimen, the treatments can be administered on a less frequent basis. For example, after administration weekly or biweekly for three months, administration can be repeated once per month, for six months or a year or longer.

Administration of the iRNA can reduce the presence of serum and/or liver HDV DNA, the presence of serum and/or liver HDV antigene.g., in a cell, tissue, blood, urine or other compartment of the patient by at least about 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more, e.g., to below the level of detection of the assay.

Before administration of a full dose of the iRNA, patients can be administered a smaller dose, such as a 5% infusion, and monitored for adverse effects, such as an allergic reaction. In another example, the patient can be monitored for unwanted immunostimulatory effects, such as increased cytokine (e.g., TNF-alpha or INF-alpha) levels.

The methods of treatment of HDV can further comprise treatment of HBV using any method known in the art. In certain embodiments, methods of treatment of HBV comprise administration of an iRNA compound, e.g., an iRNA agent targeting an HBV gene as provided herein.

Owing to the inhibitory effects on HDV expression, a composition according to the invention or a pharmaceutical composition prepared therefrom can enhance the quality of life.

An iRNA of the invention may be administered in "naked" form, where the modified or unmodified iRNA agent is directly suspended in aqueous or suitable buffer solvent, as a "free iRNA." A free iRNA is administered in the absence of a pharmaceutical composition. The free iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from a reduction and/or inhibition of HDV gene expression are those having an HDV infection and/or an HDV-associated disease or disorder as described herein.

Treatment of a subject that would benefit from a reduction and/or inhibition of HDV gene expression includes therapeutic and prophylactic treatment.

The invention further provides methods and uses of an iRNA agent or a pharmaceutical composition thereof for treating a subject that would benefit from reduction and/or inhibition of HDV gene expression, e.g., a subject having a HDV-associated disease, in combination with other pharmaceuticals and/or other therapeutic methods, e.g., with known pharmaceuticals and/or known therapeutic methods, such as, for example, those which are currently employed for treating these disorders.

For example, a subject administered a first RNAi agent or a first and second RNAi agent targeting HDV may further be administered one or more iRNA agents targeting HBV and/or one or more agents which function by a non-iRNA mechanism and which are useful in treating an HBV and/or an HDV infection. Exemplary agents include immune modulators which stimulate the immune system by, for example, enhancing T-cell helper activity, maturation of B lymphocytes, inhibiting T-cell suppressors, and enhancing HLA type I expression. Suitable immune modulators include interferons which have a variety of properties that include antiviral, immunomodulatory, and antiproliferative effects.

For example, the current treatment for chronic hepatitis B is interferon therapy. Interferon therapy is administered to subjects who have a documented HBV infection for at least six months, elevated liver enzymes (AST and ALT) and an actively dividing virus in their blood (HBeAg, and/or HBV DNA positive tests). Interferon-α therapy produces a long-term, sustained remission of the disease in about 35% of those with chronic hepatitis B, with normalization of liver enzymes and loss of the three markers for an active infection (HBeAg, HBV DNA, and HBsAg). Subjects with an acute HBV infection, end stage cirrhosis or other major medical problems are typically not treated with interferon.

In addition, interferon therapy for patients with HBV-related cirrhosis decreases significantly the hepatocellular carcinoma (HCC) rate, particularly in patients with a larger amount of serum HBV DNA. In patients with HBeAg-positive compensated cirrhosis, virological and biochemical remission following interferon therapy is associated with improved survival. In patients with chronic HBV infection, the clearance of HBeAg after treatment with interferon-α is associated with improved clinical outcomes.

The standard duration of therapy is considered 16 weeks. Patients who exhibit a low level of viral replication at the end of the standard regimen benefit most from prolonged treatment.

Thus, in some embodiments, an iRNA targeting one or more HDV genes is administered in combination with, e.g., an agent useful in treating an HDV-associated disease as described elsewhere herein.

For example, additional therapeutics and therapeutic methods suitable for treating a subject that would benefit from reduction in HDV expression, e.g., a subject having a HDV-associated disease, include an iRNA agent targeting a different portion of the HDV genome, an antiviral agent, a nucleotide analog, a nucleoside analog, a reverse transcriptase inhibitor (e.g., Tenofovir disoproxil fumarate (TDF), Tenofovir alafenamide, Lamivudine, Adefovir dipivoxil, Entecavir (ETV), Telbivudine, AGX-1009, emtricitabine, clevudine, ritonavir, dipivoxil, lobucavir, famvir, FTC, N-Acetyl-Cysteine (NAC), PC1323, theradigm-HBV, thymosin-alpha, and ganciclovir), an immune stimulator (e.g., pegylated interferon alfa 2a (PEG-IFN-α2a), Interferon alfa-2b, a recombinant human interleukin-7, and aToll-like receptor 7 (TLR7) agonist), a therapeutic vaccine (e.g., GS-4774, DV-601, and TG1050), a viral entry inhibitor (e.g., Myrcludex), an oligonucleotide that inhibits the secretion or release of HbsAg (e.g., REP 9AC), a capsid inhibitor (e.g., Bay41-4109 and NVR-1221), a cccDNA inhibitor (e.g., IHVR-25), or other therapeutic agents and/or procedures, e.g., liver transplant, chemotherapy, for treating a HBV-associated disease, a combination of any of the foregoing.

In certain embodiments, a first iRNA agent targeting one or more HDV genes is administered in combination with a second iRNA agent targeting a different portion of the HDV genome. For example, the first RNAi agent comprises a first sense strand and a first antisense strand forming a double-stranded region, wherein substantially all of the nucleotides of said first sense strand and substantially all of the nucleotides of the first antisense strand are modified nucleotides, wherein said first sense strand is conjugated to a ligand attached at the 3'-terminus, and wherein the ligand is one or more GalNAc derivatives attached through a bivalent or trivalent branched linker; and the second RNAi agent comprises a second sense strand and a second antisense strand forming a double-stranded region, wherein substantially all of the nucleotides of the second sense strand and substantially all of the nucleotides of the second antisense strand are modified nucleotides, wherein the second sense strand is conjugated to a ligand attached at the 3'-terminus, and wherein the ligand is one or more GalNAc derivatives attached through a bivalent or trivalent branched linker; wherein the first sense strand comprises a sequences selected from the group consisting of any one of the sense sequences in any one of Tables 11, 12, 31, and 32 (or a nucleotide sequence which is at least 90%, 91%, 92%, 93%, 94%, 95%, 96%, 97%, 98%, or 99% identical over its entire length to the foregoing nucleotide sequences), and wherein the first antisense strand comprises a sequence selected from the group consisting of any one of the antisense sequences in any one of Tables 11, 12, 31, and 32 (or a nucleotide sequence which is at least 90%, 91%, 92%, 93%, 94%, 95%, 96%, 97%, 98%, or 99% identical over its entire length to the foregoing nucleotide sequences); wherein the second sense strand comprises any one of the sense sequences in any one of Tables 11, 12, 31, and 32 (or a nucleotide sequence which is at least 90%, 91%, 92%, 93%, 94%, 95%, 96%, 97%, 98%, or 99% identical over its entire length to the foregoing nucleotide sequence), and wherein the second antisense strand comprises any one of the antisense sequences in any one of Tables 11, 12, 31, and 32 (or a nucleotide sequence which is at least 90%, 91%, 92%, 93%, 94%, 95%, 96%, 97%, 98%, or 99% identical over its entire length to the foregoing nucleotide sequence).

In one embodiment, the first and second sense strands each independently comprise a sequence selected from the group consisting of any one of the sense sequences from AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1 (or a nucleotide sequence which is at least 90%, 91%, 92%, 93%, 94%, 95%, 96%, 97%, 98%, or 99% identical over its entire length to the foregoing nucleotide sequences).

In another embodiment, the first and second antisense strands each independently comprise a sequence selected from the group consisting of any one of the antisense sequences from AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70272.1, AD-70271.1, AD-70268.1, AD-70269.1, AD-70232.1, AD-70256.1, AD-70257.1, or AD-70275.1 (or a nucleotide sequence which is at least 90%, 91%, 92%, 93%, 94%, 95%, 96%, 97%, 98%, or 99% identical over its entire length to the foregoing nucleotide sequences).

In one embodiment, all of the nucleotides of the first and second sense strand and/or all of the nucleotides of the first and second antisense strand comprise a modification.

In one embodiment, the at least one of the modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic A subject administered a first or a first and second RNAi agent may further be administered one or more iRNA agents targeting HBV antiviral agent, a reverse transcriptase inhibitor (e.g., Tenofovir disoproxil fumarate (TDF), Tenofovir alafenamide, Lamivudine, Adefovir dipivoxil, Entecavir (ETV), Telbivudine, and AGX-1009), an immune stimulator (e.g., pegylated interferon alfa 2a (PEG-IFN-α2a), Interferon alfa-2b, a recombinant human interleukin-7, and aToll-like receptor 7 (TLR7) agonist), a therapeutic vaccine (e.g., GS-4774, DV-601, and TG1050), a viral entry inhibitor (e.g., Myrcludex), an oligonucleotide that inhibits the secretion or release of HbsAg (e.g., REP 9AC), a capsid inhibitor (e.g., Bay41-4109 and NVR-1221), a cccDNA inhibitor (e.g., IHVR-25), or other therapeutic agents and/or procedures, e.g., liver transplant, chemotherapy, for treating a HDV-associated disease, a combination of any of the foregoing.

In one embodiment, the methods of the invention include administering to a subject having an HDV infection and/or HDV-associated disease a reverse transcriptase inhibitor. In another embodiment, the methods of the invention include administering to a subject having an HDV infection and/or HDV-associate disease a reverse transcriptase inhibitor and an immune stimulator.

The iRNA agent and an additional therapeutic agent and/or treatment may be administered at the same time and/or in the same combination, e.g., parenterally, or the additional therapeutic agent can be administered as part of a separate composition or at separate times and/or by another method known in the art or described herein.

The present invention also provides methods of using an iRNA agent of the invention and/or a composition containing an iRNA agent of the invention to reduce and/or inhibit HDV expression in a cell. In other aspects, the present invention provides an iRNA of the invention and/or a composition comprising an iRNA of the invention for use in reducing and/or inhibiting HDV gene expression in a cell. In yet other aspects, use of an iRNA of the invention and/or a composition comprising an iRNA of the invention for the manufacture of a medicament for reducing and/or inhibiting HDV gene expression in a cell are provided. In still other aspect, the present invention provides an iRNA of the invention and/or a composition comprising an iRNA of the invention for use in reducing and/or inhibiting HDV replication in a cell. In yet other aspects, use of an iRNA of the invention and/or a composition comprising an iRNA of the invention for the manufacture of a medicament for reducing and/or inhibiting HDV replication in a cell are provided. The methods and uses include contacting the cell with an iRNA, e.g., a dsRNA, of the invention and maintaining the cell for a time sufficient to obtain degradation of the mRNA transcript of an HDV gene, thereby inhibiting expression of the HDV gene or inhibiting HDV replication in the cell.

Reduction in gene expression can be assessed by any methods known in the art. For example, a reduction in the expression of HDV may be determined by determining the mRNA expression level of HDV using methods routine to one of ordinary skill in the art, e.g., Northern blotting, qRT-PCR, by determining the protein level of HDV using methods routine to one of ordinary skill in the art, such as western blotting, immunological techniques, flow cytometry methods, ELISA, and/or by determining a biological activity of HDV.

In the methods and uses of the invention the cell may be contacted in vitro or in vivo, i.e., the cell may be within a subject.

A cell suitable for treatment using the methods of the invention may be any cell that expresses an HDV gene, e.g., a cell infected with HDV or a cell comprising an expression vector comprising an HDV genome or portion of an HDV gene. A cell suitable for use in the methods and uses of the invention may be a mammalian cell, e.g., a primate cell (such as a human cell or a non-human primate cell, e.g., a monkey cell or a chimpanzee cell), a non-primate cell (such as a cow cell, a pig cell, a camel cell, a llama cell, a horse cell, a goat cell, a rabbit cell, a sheep cell, a hamster, a guinea pig cell, a cat cell, a dog cell, a rat cell, a mouse cell, a lion cell, a tiger cell, a bear cell, or a buffalo cell), a bird cell (e.g., a duck cell or a goose cell), or a whale cell. In one embodiment, the cell is a human cell, e.g., a human liver cell.

HDV gene expression may be inhibited in the cell by at least about 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100%, i.e., to below the level of detection of the assay.

HDV replication may be inhibited in the cell by at least about 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or about 100%, i.e., to below the level of detection of the assay.

The in vivo methods and uses of the invention may include administering to a subject a composition containing an iRNA, where the iRNA includes a nucleotide sequence that is complementary to at least a part of an RNA transcript of the HDV gene of the mammal to be treated. When the organism to be treated is a human, the composition can be administered by any means known in the art including, but not limited to subcutaneous, intravenous, oral, intraperitoneal, or parenteral routes, including intracranial (e.g., intraventricular, intraparenchymal and intrathecal), intramuscular, transdermal, airway (aerosol), nasal, rectal, and topical (including buccal and sublingual) administration. In certain embodiments, the compositions are administered by subcutaneous injection. In some embodiments, the compositions are administered by intravenous infusion or injection. In other embodiments, the compositions are administered by intramuscular injection.

In some embodiments, the administration is via a depot injection. A depot injection may release the iRNA in a consistent way over a prolonged time period. Thus, a depot injection may reduce the frequency of dosing needed to obtain a desired effect, e.g., a desired inhibition of HDV, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In preferred embodiments, the infusion pump is a subcutaneous infusion pump. In other embodiments, the pump is a surgically implanted pump that delivers the iRNA to the liver.

The mode of administration may be chosen based upon whether local or systemic treatment is desired and based upon the area to be treated. The route and site of administration may be chosen to enhance targeting.

In one aspect, the present invention also provides methods for inhibiting the expression of an HDV gene in a mammal, e.g., a human. The present invention also provides a composition comprising an iRNA, e.g., a dsRNA, that targets an HDV gene in a cell of a mammal for use in inhibiting expression of the HDV gene in the mammal. In another aspect, the present invention provides use of an iRNA, e.g., a dsRNA, that targets an HDV gene in a cell of a mammal in the manufacture of a medicament for inhibiting expression of the HDV gene in the mammal.

The methods and uses include administering to the mammal, e.g., a human, a composition comprising an iRNA, e.g., a dsRNA, that targets an HDV gene in a cell of the mammal and maintaining the mammal for a time sufficient to obtain degradation of the mRNA transcript of the HDV gene, thereby inhibiting expression of the HDV gene in the mammal.

Reduction in gene expression can be assessed in peripheral blood sample of the iRNA-administered subject by any methods known it the art, e.g. qRT-PCR, described herein. Reduction in protein production can be assessed by any methods known it the art and by methods, e.g., ELISA or western blotting, described herein. In one embodiment, a puncture liver biopsy sample serves as the tissue material for monitoring the reduction in HDV gene and/or protein expression. In another embodiment, a blood sample serves as the tissue material for monitoring the reduction in HDV gene and/or protein expression.

In one embodiment, verification of RISC medicated cleavage of target in vivo following administration of iRNA agent is done by performing 5'-RACE or modifications of the protocol as known in the art (Lasham A et al., (2010) *Nucleic Acid Res.,* 38 (3) p-e19) (Zimmermann et al. (2006) *Nature* 441: 111-4).

This invention is further illustrated by the following examples which should not be construed as limiting. The entire contents of all references, patents and published patent applications cited throughout this application, as well as the Figures and the Sequence Listing, are hereby incorporated herein by reference.

EXAMPLES

Example 1. iRNA Synthesis

Source of Reagents

Where the source of a reagent is not specifically given herein, such reagent can be obtained from any supplier of reagents for molecular biology at a quality/purity standard for application in molecular biology.

Transcripts siRNA Design

The selection of siRNA designs targeting HBV was driven by two primary factors: a) potency and b), the desire to employ siRNA with near-perfect matches with greater than 90% fractional coverage of the large number of public HBV sequences of all known serotypes (A through H). The coordinates for the siRNA selection were determined relative to the NCBI HBV reference genome sequence NC_003977.1 (GenBank Accession No. GI:21326584 (SEQ ID NO:1). The reverse complement of SEQ ID NO:1 is provided in SEQ ID NO:2. A first set of siRNAs containing structure-activity modifications, including various 2'-O-methyl and 2'-fluoro substitution patterns, centered on two adjacent regions of the HBV genome coding for surface antigen (HbSAg) and the HBV polymerase, were designed, synthesized and screened in-vitro. A second set of siRNAs were designed, synthesized and screened targeting additional target regions with particular attention to positions 1581-1599 of SEQ ID NO:1 that code, in addition to the HbSAg and polymerase, the X gene.

The sequence of Hepatitis B virus genomic DNA, complete sequence, isolate 22Y04HCC (GenBank Accession No., GI: 3582357) and its reverse complement are provided in SEQ ID NOs. 3 and 4, respectively.

A detailed list of the unmodified HBV sense and antisense strand sequences is shown in Tables 3, 14, 24, and 27.

A detailed list of the modified HBV sense and antisense strand sequences is shown in Tables 4, 6, 15, 25, and 28.

siRNA Synthesis

HBV siRNA sequences were synthesized at 1 μmol scale on Mermade 192 synthesizer (BioAutomation) using the solid support mediated phosphoramidite chemistry. The solid support was controlled pore glass (500 A) loaded with custom GalNAc ligand or universal solid support (AM biochemical). Ancillary synthesis reagents, 2'-F and 2'-O-Methyl RNA and deoxy phosphoramidites were obtained from Thermo-Fisher (Milwaukee, Wis.) and Hongene (China). 2'F 2'-O-Methyl, GNA (glycol nucleic acids), 5'phosphate and abasic modifications were introduced employing the corresponding phosphoramidites. Synthesis of 3' GalNAc conjugated single strands was performed on a GalNAc modified CPG support. Custom CPG universal solid support was used for the synthesis of antisense single strands. Coupling time for all phosphoramidites (100 mM in acetonitrile) was 5 min employing 5-Ethylthio-1H-tetrazole (ETT) as activator (0.6 M in acetonitrile). Phosphorothioate linkages were generated using a 50 mM solution of 3-((Dimethylamino-methylidene) amino)-3H-1,2,4-dithiazole-3-thione (DDTT, obtained from Chemgenes (Wilmington, Mass., USA)) in anhydrous acetonitrile/pyridine (1:1 v/v). Oxidation time was 3 minutes. All sequences were synthesized with final removal of the DMT group ("DMT off").

Upon completion of the solid phase synthesis, oligoribonucleotides were cleaved from the solid support and deprotected in sealed 96 deep well plates using 200 µL Aqueous Methylamine reagents at 60° C. for 20 minutes. At the end of cleavage and deprotection step, the synthesis plate was allowed to come to room temperature and was precipitated by addition of 1 mL of acetontile: ethanol mixture (9:1). The plates were cooled at −80 C for 2 hrs, superanatant decanted carefully with the aid of a multi channel pipette. The oligonucleotide pellet was re-suspended in 20 mM NaOAc buffer and were desalted using a 5 mL HiTrap size exclusion column (GE Healthcare) on an AKTA Purifier System equipped with an A905 autosampler and a Frac 950 fraction collector. Desalted samples were collected in 96-well plates. Samples from each sequence were analyzed by LC-MS to confirm the identity, UV (260 nm) for quantification and a selected set of samples by IEX chromatography to determine purity.

Annealing of HBV single strands was performed on a Tecan liquid handling robot. Equimolar mixture of sense and antisense single strands were combined and annealed in 96 well plates. After combining the complementary single strands, the 96-well plate was sealed tightly and heated in an oven at 100° C. for 10 minutes and allowed to come slowly to room temperature over a period 2-3 hours. The concentration of each duplex was normalized to 10 µM in 1×PBS.

Example 2. In Vitro Screening of siRNA Duplexes

Cell Culture and Transfections

Cos7 cells (ATCC, Manassas, Va.) were grown to near confluence at 37° C. in an atmosphere of 5% CO2 in DMEM (ATCC) supplemented with 10% FBS, before being released from the plate by trypsinization. Dual-Glo® Luciferaseconstructs generated in the psiCHECK2 plasmid containing approximately 1.1 kb of HBV genomic sequences were transfected into approximately 15×10$^4$ cells using Lipofectamine 2000 (Invitrogen, Carlsbad Calif. cat #11668-019). For each well of a 96 well plate, 0.2 µl of Lipofectamine was added to 10 ng of plasmid vector in 14.8 µl of Opti-MEM and allowed to complex at room temperature for 15 minutes. The mixture was then added to the cells which were resuspended in 80 µl of fresh complete media. After approximately 24 hours, the media were removed and the cells re-transfected with siRNA. Each siRNA was transfected into cells that had previously been transfected with the psiCHECK2-HBV vector that had a perfect match for the siRNA. siRNA transfection was carried out by adding 14.8 µl of Opti-MEM plus 0.2 µl of Lipofectamine RNAiMax per well (Invitrogen, Carlsbad Calif. cat #13778-150) to 5 µl of siRNA duplexes per well into a 96-well plate and incubated at room temperature for 15 minutes. The mixture was then added to the cells previously transfected with the psiCHECK2-HBV plasmid that had a perfect match to the siRNA sequence. Cells were incubated for 24 hours before luciferase was measured.

Single dose experiments were performed at 10 nM and 0.01 nM final duplex concentration.

Dual-Glo® Luciferase Assay

Twenty-four hours after the siRNAs were transfected, Firefly (transfection control) and Rinella (fused to HBV target sequence) luciferase were measured. First, media was removed from cells. Then Firefly luciferase activity was measured by adding 75 µl of Dual-Glo® Luciferase Reagent equal to the culture medium volume to each well and mix. The mixture was incubated at room temperature for 30 minutes before lunimescense (500 nm) was measured on a Spectramax (Molecular Devices) to detect the Firefly luciferase signal. Renilla luciferase activity was measured by adding 75 µl of room temperature of Dual-Glo® Stop & Glo® Reagent was added to each well and the plates were incubated for 10-15 minutes before luminescence was again measured to determine the Renilla luciferase signal. The Dual-Glo® Stop & Glo® Reagent, quench the firefly luciferase signal and sustain luminescence for the Renilla luciferase reaction. siRNA activity was determined by normalizing the Renilla (HBV) signal to the Firefly (control) signal within each well. The magnitude of siRNA activity was then assessed relative to cells that were transfected with the same vector but were not treated with siRNA or were treated with a non-targeting siRNA. All transfections were done at n=2 or greater.

Essentially the same methods were used to screen siRNA targeted to HDV.

Table 5 shows the results of a single dose screen in Cos7 cells transfected with the indicated HBV iRNAs. Data are expressed as percent of mRNA remaining relative to negative control.

TABLE 2

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
| --- | --- |
| A | Adenosine-3'-phosphate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide (G, A, C, T or U) |
| a | 2'-O-methyladenosine-3'-phosphate |

TABLE 2-continued

Abbreviations of nucleotide monomers used in nucleic acid sequence representation. It will be understood that these monomers, when present in an oligonucleotide, are mutually linked by 5'-3'-phosphodiester bonds.

| Abbreviation | Nucleotide(s) |
|---|---|
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L96 | N-[tris(GalNAc-alkyl)-amidodecanoyl)]-4-hydroxyprolinol Hyp-(GalNAc-alkyl)3 |
| (dt) | deoxy-thymine |
| Y34 | 2-hydroxymethyl-tetrahydrofurane-4-methoxy-3-phosphate (abasic 2'-OMe furanose) |
| Y44 | 2-hydroxymethyl-tetrahydrofurane-5-phosphate |
| (Agn) | Adenosine-glycol nucleic acid (GNA) |
| (Tgn) | Thymidine-glycol nucleic acid (GNA) S-Isomer |
| (Cgn) | Cytidine-glycol nucleic acid (GNA) |
| P | Phosphate |
| VP | Vinyl-phosphate |

TABLE 3

Unmodified Sense and Antisense Strand Sequences of HBV dsRNAs

| Duplex Name | Sense Oligo Name | Sense Sequence (5' to 3') | SEQ ID NO: | Antisense Oligo Name | Antisense Sequence (5' to 3') | SEQ ID NO: | Position in NC_003977.1 |
|---|---|---|---|---|---|---|---|
| AD-61522.2 | A-123463.2 | AGUUAUAUGGAUGAUGUGGUA | 121 | A-123464.2 | UACCACAUCAUCCAUAUAACUGA | 556 | 731_753 |
| AD-61547.2 | A-123487.2 | GGAUGUGUCUGCGGCGUUUUA | 122 | A-123488.2 | UAAAACGCCGCAGACACAUCCAG | 557 | 373_395 |
| AD-63938.2 | A-127896.1 | ACUCGUGGUGGACUUCUCUCA | 123 | A-127897.1 | UGAGAGAAGUCCACCACGAGUCU | 558 | 250_272 |
| AD-63939.2 | A-127909.1 | ACUCGUGGUGGACUUCUCUCA | 124 | A-127906.3 | UGAGAGAAGUCCACCACGAGUCU | 559 | 250_272 |
| AD-63940.2 | A-127917.1 | ACUCGUGGUGGACUUCTCUCA | 125 | A-127906.11 | UGAGAGAAGUCCACCACGAGUCU | 560 | 250_272 |
| AD-63940.3 | A-127917.4 | ACUCGUGGUGGACUUCTCUCA | 126 | A-127906.19 | UGAGAGAAGUCCACCACGAGUCU | 561 | 250_272 |
| AD-63941.2 | A-127905.8 | ACUCGUGGUGGACUUCUCUCA | 127 | A-127925.1 | UGAGAGAAGUCCACCACGAGUCU | 562 | 250_272 |
| AD-63942.2 | A-127933.1 | UCGUGGUGGACUUCUCUCA | 128 | A-127934.1 | UGAGAGAAGUCCACCACGAGU | 563 | 252_274 |
| AD-63943.2 | A-127944.2 | ACUCGUGGUGGACUUCUCUCA | 129 | A-127942.2 | UGAGAGAAGUCCACCACGAGUCU | 564 | 250_272 |
| AD-63945.2 | A-127910.1 | ACUCGUGGUGGACUUCUCUCA | 130 | A-127906.4 | UGAGAGAAGUCCACCACGAGUCU | 565 | 250_272 |
| AD-63946.2 | A-127918.1 | ACUCGUGGUGGACUUCUCUCA | 131 | A-127906.12 | UGAGAGAAGUCCACCACGAGUCU | 566 | 250_272 |
| AD-63947.2 | A-127905.9 | ACUCGUGGUGGACUUCUCUCA | 132 | A-127926.1 | UGAGAGAAGUCCACCACGAGUCU | 567 | 250_272 |
| AD-63948.2 | A-127935.1 | GUGGUGGACUUCUCUCA | 133 | A-127936.1 | UGAGAGAAGUCCACCACGA | 568 | 254_276 |
| AD-63949.2 | A-127944.3 | ACUCGUGGUGGACUUCUCUCA | 134 | A-127906.14 | UGAGAGAAGUCCACCACGAGUCU | 569 | 250_272 |
| AD-63950.2 | A-127900.1 | UCGUGGUGGACUUCUCUCAUU | 135 | A-127901.1 | UGAGAGAAGUCCACCACGAUU | 570 | 252_274 |
| AD-63951.2 | A-127911.1 | ACUCGUGGUGGACUUCUCUCA | 136 | A-127906.5 | UGAGAGAAGUCCACCACGAGUCU | 571 | 250_272 |
| AD-63952.2 | A-127905.2 | ACUCGUGGUGGACUUCUCUCA | 137 | A-127919.1 | UGAGAGAAGUCCACCACGAGUCU | 572 | 250_272 |
| AD-63953.2 | A-127905.10 | ACUCGUGGUGGACUUCUCUCA | 138 | A-127927.1 | UGAGAGAAGUCCACCACGAGUCU | 573 | 250_272 |
| AD-63955.2 | A-127945.1 | ACUCGUGGUGGACUUCUCUCA | 139 | A-127940.3 | UGAGAGAAGUCCACCACGAGUCU | 574 | 250_272 |
| AD-63956.2 | A-127902.1 | UCGUGGUGGACUUCUCUCA | 140 | A-127903.1 | UGAGAGAAGUCCACCACGAUU | 575 | 252_274 |
| AD-63957.2 | A-127912.1 | ACUCGUGGUGGACUUCUCUCA | 141 | A-127906.6 | UGAGAGAAGUCCACCACGAGUCU | 576 | 250_272 |
| AD-63958.2 | A-127905.3 | ACUCGUGGUGGACUUCUCUCA | 142 | A-127920.1 | UGAGAGAAGUCCACCACGAGUCU | 577 | 250_272 |
| AD-63959.2 | A-127905.11 | ACUCGUGGUGGACUUCUCUCA | 143 | A-127928.1 | UGAGAGAAGUCCACCACGAGUCU | 578 | 250_272 |
| AD-63960.2 | A-126619.2 | UAUUUCCUAGGGUACAA | 144 | A-127938.1 | UGAGAGAAGUCCACCACGA | 579 | 254_276 |
| AD-63961.2 | A-127945.2 | ACUCGUGGUGGACUUCUCUCA | 145 | A-127942.3 | UGAGAGAAGUCCACCACGAGUCU | 580 | 250_272 |
| AD-63962.2 | A-127902.2 | UCGUGGUGGACUUCUCUCA | 146 | A-127904.1 | UGAGAGAAGUCCACCACGAUU | 581 | 252_274 |

TABLE 3-continued

Unmodified Sense and Antisense Strand Sequences of HBV dsRNAs

| Duplex Name | Sense Oligo Name | Sense Sequence (5' to 3') | SEQ ID NO: | Antisense Oligo Name | Antisense Sequence (5' to 3') | SEQ ID NO: | Position in NC_003977.1 |
|---|---|---|---|---|---|---|---|
| AD-63963.2 | A-127913.1 | ACUCGUGGUGGACUUCUCUCA | 147 | A-127906.7 | UGAGAGAAGUCCACCACGAGUCU | 582 | 250_272 |
| AD-63964.2 | A-127905.4 | ACUCGUGGUGGACUUCUCUCA | 148 | A-127921.1 | UGAGAGAAGUCCACCACGAGUCU | 583 | 250_272 |
| AD-63965.2 | A-127905.12 | ACUCGUGGUGGACUUCUCUCA | 149 | A-127929.1 | UGAGAGAAGUCCACCACGAGUCU | 584 | 250_272 |
| AD-63966.2 | A-127939.1 | ACUCGUGGUGGACUUCUCUCA | 150 | A-127940.1 | UGAGAGAAGUCCACCACGAGUCU | 585 | 250_272 |
| AD-63967.2 | A-127945.3 | ACUCGUGGUGGACUUCUCUCA | 151 | A-127906.15 | UGAGAGAAGUCCACCACGAGUCU | 586 | 250_272 |
| AD-63968.2 | A-127905.1 | ACUCGUGGUGGACUUCUCUCA | 152 | A-127906.1 | UGAGAGAAGUCCACCACGAGUCU | 587 | 250_272 |
| AD-63968.2 | A-127905.1 | ACUCGUGGUGGACUUCUCUCA | 153 | A-127906.1 | UGAGAGAAGUCCACCACGAGUCU | 588 | 250_272 |
| AD-63968.4 | A-127905.15 | ACUCGUGGUGGACUUCUCUCA | 154 | A-127906.17 | UGAGAGAAGUCCACCACGAGUCU | 589 | 250_272 |
| AD-63968.5 | A-127905.17 | ACUCGUGGUGGACUUCUCUCA | 155 | A-127906.18 | UGAGAGAAGUCCACCACGAGUCU | 590 | 250_272 |
| AD-63969.2 | A-127914.1 | ACUCGUGGUGGACUUCUCUCA | 156 | A-127906.8 | UGAGAGAAGUCCACCACGAGUCU | 591 | 250_272 |
| AD-63970.2 | A-127905.5 | ACUCGUGGUGGACUUCUCUCA | 157 | A-127922.1 | UGAGAGAAGUCCACCACGAGUCU | 592 | 250_272 |
| AD-63971.2 | A-127905.13 | ACUCGUGGUGGACUUCUCUCA | 158 | A-127930.1 | UGAGAGAAGUCCACCACGAGUCU | 593 | 250_272 |
| AD-63972.2 | A-127941.1 | ACUCGUGGUGGACUUCUCUCA | 159 | A-127942.1 | UGAGAGAAGUCCACCACGAGUCU | 594 | 250_272 |
| AD-63973.2 | A-127946.1 | ACUCGUGGUGGACUUCUCUCA | 160 | A-127947.1 | UGAGAGAAGTCCACCACGAGUCU | 595 | 250_272 |
| AD-63975.2 | A-127915.1 | ACUCGUGGUGGACUUCTCUCA | 161 | A-127906.9 | UGAGAGAAGUCCACCACGAGUCU | 596 | 250_272 |
| AD-63976.2 | A-127905.6 | ACUCGUGGUGGACUUCUCUCA | 162 | A-127923.1 | UGAGAGAAGUCCACCACGAGUCU | 597 | 250_272 |
| AD-63977.2 | A-127917.2 | ACUCGUGGUGGACUUCTCUCA | 163 | A-127931.1 | UGAGAGAAGUCCACCACGAGUCU | 598 | 250_272 |
| AD-63978.2 | A-127943.1 | ACUCGUGGUGGACUUCUCUCA | 164 | A-127906.13 | UGAGAGAAGUCCACCACGAGUCU | 599 | 250_272 |
| AD-63979.2 | A-127908.1 | ACUCGUGGUGGACUUCUCUCA | 165 | A-127906.2 | UGAGAGAAGUCCACCACGAGUCU | 600 | 250_272 |
| AD-63980.2 | A-127916.1 | ACUCGUGGUGGACUUCTCUCA | 166 | A-127906.10 | UGAGAGAAGUCCACCACGAGUCU | 601 | 250_272 |
| AD-63981.2 | A-127905.7 | ACUCGUGGUGGACUUCUCUCA | 167 | A-127924.1 | UGAGAGAAGUCCACCACGAGUCU | 602 | 250_272 |
| AD-63982.2 | A-127917.3 | ACUCGUGGUGGACUUCTCUCA | 168 | A-127932.1 | UGAGAGAAGUCCACCACGAGUCU | 603 | 250_272 |
| AD-63983.2 | A-127944.1 | ACUCGUGGUGGACUUCUCUCA | 169 | A-127940.2 | UGAGAGAAGUCCACCACGAGUCU | 604 | 250_272 |
| AD-63985.2 | A-127961.1 | GUGGUGGACUUCUCUCAAUUU | 170 | A-127956.4 | AAAUUGAGAGAAGUCCACCACGA | 605 | 254_276 |
| AD-63986.2 | A-127969.1 | GUGGUGGACUUCUCUCAAUUU | 171 | A-127956.12 | AAAUUGAGAGAAGUCCACCACGA | 606 | 254_276 |
| AD-63987.2 | A-127955.9 | GUGGUGGACUUCUCUCAAUUU | 172 | A-127977.1 | AAAUUGAGAGAAGUCCACCACGA | 607 | 254_276 |
| AD-63988.2 | A-127986.1 | UGGACUUCUCUCAAUUU | 173 | A-127987.1 | AAAUUGAGAGAAGUCCACC | 608 | 258_280 |
| AD-63989.2 | A-127996.1 | GUGGUGGACUUCUCUCAAUUU | 174 | A-127992.2 | AAAUUGAGAGAAGUCCACCACGA | 609 | 254_276 |
| AD-63990.2 | A-127950.1 | GGUGGACUUCUCUCAAUUUU | 175 | A-127951.1 | AAAUUGAGAGAAGUCCACCUU | 610 | 256_278 |
| AD-63991.2 | A-127962.1 | GUGGUGGACUUCUCUCAAUUU | 176 | A-127956.5 | AAAUUGAGAGAAGUCCACCACGA | 611 | 254_276 |
| AD-63992.2 | A-127955.2 | GUGGUGGACUUCUCUCAAUUU | 177 | A-127970.1 | AAAUUGAGAGAAGUCCACCACGA | 612 | 254_276 |
| AD-63993.2 | A-127955.10 | GUGGUGGACUUCUCUCAAUUU | 178 | A-127978.1 | AAAUUGAGAGAAGUCCACCACGA | 613 | 254_276 |
| AD-63994.2 | A-127984.2 | GGUGGACUUCUCUCAAUUU | 179 | A-127988.1 | AAAUUGAGAGAAGUCCACCAC | 614 | 256_278 |
| AD-63995.2 | A-127996.2 | GUGGUGGACUUCUCUCAAUUU | 180 | A-127993.2 | AAAUUGAGAGAAGUCCACCACGA | 615 | 254_276 |
| AD-63996.2 | A-127952.1 | GGUGGACUUCUCUCAAUUU | 181 | A-127953.1 | AAAUUGAGAGAAGUCCACCUU | 616 | 256_278 |
| AD-63997.2 | A-127963.1 | GUGGUGGACUUCUCUCAAUUU | 182 | A-127956.6 | AAAUUGAGAGAAGUCCACCACGA | 617 | 254_276 |
| AD-63999.2 | A-127955.11 | GUGGUGGACUUCUCUCAAUUU | 183 | A-127979.1 | AAAUUGAGAGAAGUCCACCACGA | 618 | 254_276 |

TABLE 3-continued

Unmodified Sense and Antisense Strand Sequences of HBV dsRNAs

| Duplex Name | Sense Oligo Name | Sense Sequence (5' to 3') | SEQ ID NO: | Antisense Oligo Name | Antisense Sequence (5' to 3') | SEQ ID NO: | Position in NC_003977.1 |
|---|---|---|---|---|---|---|---|
| AD-64000.2 | A-127986.2 | UGGACUUCUCUCAAUUU | 184 | A-127989.1 | AAAUUGAGAGAAGUCCACC | 619 | 258_280 |
| AD-64001.2 | A-127996.3 | GUGGUGGACUUCUCUCAAUUU | 185 | A-127994.2 | AAAUUGAGAGAAGUCCACCACGA | 620 | 254_276 |
| AD-64002.2 | A-127952.2 | GGUGGACUUCUCUCAAUUU | 186 | A-127954.1 | AAAUUGAGAGAAGUCCACCUU | 621 | 256_278 |
| AD-64003.2 | A-127964.1 | GUGGUGGACUUCUCUCAAUUU | 187 | A-127956.7 | AAAUUGAGAGAAGUCCACCACGA | 622 | 254_276 |
| AD-64004.2 | A-127955.4 | GUGGUGGACUUCUCUCAAUUU | 188 | A-127972.1 | AAAUUGAGAGAAGUCCACCACGA | 623 | 254_276 |
| AD-64005.2 | A-127955.12 | GUGGUGGACUUCUCUCAAUUU | 189 | A-127980.1 | AAAUUGAGAGAAGUCCACCACGA | 624 | 254_276 |
| AD-64006.2 | A-127990.1 | GUGGUGGACUUCUCUCAAUUU | 190 | A-127991.1 | AAAUUGAGAGAAGUCCACCACGA | 625 | 254_276 |
| AD-64007.2 | A-127996.4 | GUGGUGGACUUCUCUCAAUUU | 191 | A-127995.2 | AAAUUGAGAGAAGUCCACCACGA | 626 | 254_276 |
| AD-64008.2 | A-127955.1 | GUGGUGGACUUCUCUCAAUUU | 192 | A-127956.1 | AAAUUGAGAGAAGUCCACCACGA | 627 | 254_276 |
| AD-64008.2 | A-127955.1 | GUGGUGGACUUCUCUCAAUUU | 193 | A-127956.1 | AAAUUGAGAGAAGUCCACCACGA | 628 | 254_276 |
| AD-64008.4 | A-127955.15 | GUGGUGGACUUCUCUCAAUUU | 194 | A-127956.14 | AAAUUGAGAGAAGUCCACCACGA | 629 | 254_276 |
| AD-64009.2 | A-127965.1 | GUGGUGGACUUCUCUCAAUUU | 195 | A-127956.8 | AAAUUGAGAGAAGUCCACCACGA | 630 | 254_276 |
| AD-64010.2 | A-127955.5 | GUGGUGGACUUCUCUCAAUUU | 196 | A-127973.1 | AAAUUGAGAGAAGUCCACCACGA | 631 | 254_276 |
| AD-64011.2 | A-127955.13 | GUGGUGGACUUCUCUCAAUUU | 197 | A-127981.1 | AAAUUGAGAGAAGUCCACCACGA | 632 | 254_276 |
| AD-64012.2 | A-127990.2 | GUGGUGGACUUCUCUCAAUUU | 198 | A-127992.1 | AAAUUGAGAGAAGUCCACCACGA | 633 | 254_276 |
| AD-64013.2 | A-127997.1 | GUGGUGGACTTCUCUCAAUUU | 199 | A-127998.1 | AAAUUGAGAGAAGTCCACCACGA | 634 | 254_276 |
| AD-64014.2 | A-127957.1 | GUGGUGGACUUCUCUCAAUUU | 200 | A-127958.1 | AAAUUGAGAGAAGUCCACCACGA | 635 | 254_276 |
| AD-64015.2 | A-127966.1 | GUGGUGGACUUCUCUCAAUUU | 201 | A-127956.9 | AAAUUGAGAGAAGUCCACCACGA | 636 | 254_276 |
| AD-64016.2 | A-127955.6 | GUGGUGGACUUCUCUCAAUUU | 202 | A-127974.1 | AAAUUGAGAGAAGUCCACCACGA | 637 | 254_276 |
| AD-64017.2 | A-127968.2 | GUGGUGGACUTCUCUCAAUUU | 203 | A-127982.1 | AAAUUGAGAGAAGTCCACCACGA | 638 | 254_276 |
| AD-64018.2 | A-127990.3 | GUGGUGGACUUCUCUCAAUUU | 204 | A-127993.1 | AAAUUGAGAGAAGUCCACCACGA | 639 | 254_276 |
| AD-64019.2 | A-127959.1 | GUGGUGGACUUCUCUCAAUUU | 205 | A-127956.2 | AAAUUGAGAGAAGUCCACCACGA | 640 | 254_276 |
| AD-64020.2 | A-127967.1 | GUGGUGGACUUCUCUCAAUUU | 206 | A-127956.10 | AAAUUGAGAGAAGUCCACCACGA | 641 | 254_276 |
| AD-64021.2 | A-127955.7 | GUGGUGGACUUCUCUCAAUUU | 207 | A-127975.1 | AAAUUGAGAGAAGUCCACCACGA | 642 | 254_276 |
| AD-64022.2 | A-127968.3 | GUGGUGGACUTCUCUCAAUUU | 208 | A-127983.1 | AAAUUGAGAGAAGTCCACCACGA | 643 | 254_276 |
| AD-64023.2 | A-127990.4 | GUGGUGGACUUCUCUCAAUUU | 209 | A-127994.1 | AAAUUGAGAGAAGUCCACCACGA | 644 | 254_276 |
| AD-64024.2 | A-127960.1 | GUGGUGGACUUCUCUCAAUUU | 210 | A-127956.3 | AAAUUGAGAGAAGUCCACCACGA | 645 | 254_276 |
| AD-64025.2 | A-127968.1 | GUGGUGGACUTCUCUCAAUUU | 211 | A-127956.11 | AAAUUGAGAGAAGUCCACCACGA | 646 | 254_276 |
| AD-64026.2 | A-127955.8 | GUGGUGGACUUCUCUCAAUUU | 212 | A-127976.1 | AAAUUGAGAGAAGUCCACCACGA | 647 | 254_276 |
| AD-64027.2 | A-127984.1 | GGUGGACUUCUCUCAAUUU | 213 | A-127985.1 | AAAUUGAGAGAAGUCCACCAC | 648 | 256_278 |
| AD-64028.2 | A-127990.5 | GUGGUGGACUUCUCUCAAUUU | 214 | A-127995.1 | AAAUUGAGAGAAGUCCACCACGA | 649 | 254_276 |
| AD-64272.2 | A-128001.2 | GUGCACUUCGCUUCACCUCUG | 215 | A-128002.2 | CAGAGGUGAAGCGAAGUGCACAC | 650 | 1577_1599 |
| AD-64274.1 | A-128363.1 | GUUGACAAAAUCCUCACAAU | 216 | A-128364.1 | AUUGUGAGGAUUUUUGUCAACAA | 651 | 215_237 |
| AD-64275.1 | A-128377.1 | UGUUGACAAAAUCCUCACAA | 217 | A-128378.1 | UUGUGAGGAUUUUUGUCAACAAG | 652 | 214_236 |
| AD-64276.1 | A-128393.1 | GGUGGACUUCUCUCAAUUUUA | 218 | A-128394.1 | UAAAAUUGAGAGAAGUCCACCAC | 653 | 256_278 |
| AD-64277.1 | A-128407.1 | UCUUUUGGAGUGUGGAUUCGA | 219 | A-128408.1 | UCGAAUCCACACUCCAAAGACA | 654 | 2259_2281 |
| AD-64277.1 | A-128407.1 | UCUUUUGGAGUGUGGAUUCGA | 220 | A-128408.1 | UCGAAUCCACACUCCAAAGACA | 655 | 2259_2281 |

TABLE 3-continued

Unmodified Sense and Antisense Strand Sequences of HBV dsRNAs

| Duplex Name | Sense Oligo Name | Sense Sequence (5' to 3') | SEQ ID NO: | Antisense Oligo Name | Antisense Sequence (5' to 3') | SEQ ID NO: | Position in NC_003977.1 |
|---|---|---|---|---|---|---|---|
| AD-64278.1 | A-128423.1 | ACUGUUCAAGCCUCCAAGCUA | 221 | A-128424.1 | UAGCUUGGAGGCUUGAACAAGAC | 656 | 1857_1879 |
| AD-64279.1 | A-128435.1 | UCUGCCGAUCCAUACUGCGGA | 222 | A-128436.1 | UCCGCAGUAUGGAUCGGCAGAGG | 657 | 1255_1277 |
| AD-64280.1 | A-128379.1 | AUGUGUCUGCGGCGUUUUAUA | 223 | A-128380.1 | UAUAAAACGCCGCAGACACAUCC | 658 | 375_397 |
| AD-64281.1 | A-128395.1 | CCCCGUCUGUGCCUUCUCAUA | 224 | A-128396.1 | UAUGAGAAGGCACAGACGGGGAG | 659 | 1545_1567 |
| AD-64282.1 | A-128409.1 | GCCUAAUCAUCUCUUGUUCAU | 225 | A-128410.1 | AUGAACAAGAGAUGAUUAGCGAG | 660 | 1831_1853 |
| AD-64283.1 | A-128425.1 | UCUAGACUCGUGGUGGACUUC | 226 | A-128426.1 | GAAGUCCACCACGAGUCUAGACU | 661 | 245_267 |
| AD-64284.1 | A-128437.1 | CUGCCGAUCCAUACUGCGGAA | 227 | A-128438.1 | UUCCGCAGUAUGGAUCGGCAGAG | 662 | 1256_1278 |
| AD-64285.1 | A-128365.1 | UUUUUCUUGUUGACAAAAAUA | 228 | A-128366.1 | UAUUUUUGUCAACAAGAAAAACC | 663 | 207_229 |
| AD-64286.1 | A-128381.1 | AUCUUCUUGUUGGUUCUUCUA | 229 | A-128382.1 | UAGAAGAACCAACAAGAAGAUGA | 664 | 426_448 |
| AD-64289.1 | A-128367.1 | GUUUUUCUUGUUGACAAAAAU | 230 | A-128368.1 | AUUUUUGUCAACAAGAAAAACCC | 665 | 206_228 |
| AD-64290.1 | A-128383.1 | CUGCCUAAUCAUCUCUUGUUA | 231 | A-128384.1 | UAACAAGAGAUGAUUAGGCAGAG | 666 | 1829_1851 |
| AD-64291.1 | A-128399.1 | UCCUCACAAUACCACAGAGUA | 232 | A-128400.1 | UACUCUGUGGUAUUGUGAGGAUU | 667 | 226_248 |
| AD-64292.1 | A-128413.1 | CUUGUUGACAAAAAUCCUCAA | 233 | A-128414.1 | UUGAGGAUUUUUGUCAACAAGAA | 668 | 212_234 |
| AD-64293.1 | A-128439.1 | GCAACUUUUUCACCUCUGCCU | 234 | A-128440.1 | AGGCAGAGGUGAAAAAGUUGCAU | 669 | 1814_1836 |
| AD-64294.1 | A-128369.1 | GGGAACAAGAGCUACAGCAUA | 235 | A-128370.1 | UAUGCUGUAGCUCUUGUUCCCAA | 670 | 2828_2850 |
| AD-64295.1 | A-128385.1 | CGUGGUGGACUUCUCUCAAUU | 236 | A-128386.1 | AAUUGAGAGAAGUCCACCAGCAG | 671 | 253_275 |
| AD-64297.1 | A-128415.1 | CUGCUGCUAUGCCUCAUCUUA | 237 | A-128416.1 | UAAGAUGAGGCAUAGCAGCAGGA | 672 | 411_433 |
| AD-64298.1 | A-128427.1 | GUUGGAUGUGUCUGCGGCGUU | 238 | A-128428.1 | AACGCCGCAGACACAUCCAACGA | 673 | 370_392 |
| AD-64299.1 | A-128441.1 | UUCAUCCUGCUGCUAUGCCUA | 239 | A-128442.1 | UAGGCAUAGCAGCAGGAUGAAGA | 674 | 405_427 |
| AD-64300.1 | A-128371.1 | UUCUUGUUGACAAAAAUCCUA | 240 | A-128372.1 | UAGGAUUUUUGUCAACAAGAAAA | 675 | 210_232 |
| AD-64302.1 | A-128417.1 | UAUAUGGAUGAUGUGGUAUUA | 241 | A-128418.1 | UAAUACCACAUCAUCCAUAUAAC | 676 | 734_756 |
| AD-64303.1 | A-128429.1 | UUCAUCCUGCUGCUAUGCCUC | 242 | A-128430.1 | GAGGCAUAGCAGCAGGAUGAAGA | 677 | 405_427 |
| AD-64304.1 | A-128443.1 | GUGCACUUCGCUUCACCUCUA | 243 | A-128444.1 | UAGAGGUGAAGCGAAGUGCACAC | 678 | 1577_1599 |
| AD-64305.1 | A-128373.1 | UUGACAAAAAUCCUCACAAUA | 244 | A-128374.1 | UAUUGUGAGGAUUUUUGUCAACA | 679 | 216_238 |
| AD-64307.1 | A-128403.1 | AAGCCUCCAAGCUGUGCCUUA | 245 | A-128404.1 | UAAGGCACAGCUUGGAGGCUUGA | 680 | 1864_1886 |
| AD-64308.1 | A-128419.1 | CCUCUUCAUCCUGCUGCUAUA | 246 | A-128420.1 | UAUAGCAGCAGGAUGAAGAGGAA | 681 | 401_423 |
| AD-64309.1 | A-128431.1 | CCUGCUGCUAUGCCUCAUCUU | 247 | A-128432.1 | AAGAUGAGGCAUAGCAGCAGGAU | 682 | 410_432 |
| AD-64310.1 | A-128375.1 | CAUCUUCUUGUUGGUUCUUCU | 248 | A-128376.1 | AGAAGAACCAACAAGAAGAUGAG | 683 | 425_447 |
| AD-64311.1 | A-128391.1 | CCGUCUGUGCCUUCUCAUCUA | 249 | A-128392.1 | UAGAUGAGAAGGCACAGACGGGG | 684 | 1547_1569 |
| AD-64312.1 | A-128405.1 | CCUCAUCUUCUUGUUGGUUCU | 250 | A-128406.1 | AGAACCAACAAGAAGAUGAGGCA | 685 | 422_444 |
| AD-64313.1 | A-128421.1 | CCACCAAAUGCCCCUAUCUUA | 251 | A-128422.1 | UAAGAUAGGGGCAUUUGGUGGUC | 686 | 2298_2320 |
| AD-64314.1 | A-128433.1 | GCUCCUCUGCCGAUCCAUACU | 252 | A-128434.1 | AGUAUGGAUCGGCAGAGGAGCCA | 687 | 1250_1272 |
| AD-64315.1 | A-128363.2 | GUUGACAAAAAUCCUCACAAU | 253 | A-128445.1 | AUUGUGAGGAUUUUUGUCAACAA | 688 | 215_237 |
| AD-64316.1 | A-128377.2 | UGUUGACAAAAAUCCUCACAA | 254 | A-128453.1 | UUGUGAGGAUUUUUGUCAACAAG | 689 | 214_236 |
| AD-64317.1 | A-128393.2 | GGUGGACUUCUCUCAAUUUUA | 255 | A-128461.1 | UAAAAUUGAGAGAAGUCCACCAC | 690 | 256_278 |
| AD-64318.1 | A-128407.2 | UCUUUUGGAGUGUGGAUUCGA | 256 | A-128469.1 | UCGAAUCCACACUCCAAAGACA | 691 | 2259_2281 |
| AD-64318.1 | A-128407.2 | UCUUUUGGAGUGUGGAUUCGA | 257 | A-128469.1 | UCGAAUCCACACUCCAAAGACA | 692 | 2259_2281 |

TABLE 3-continued

Unmodified Sense and Antisense Strand Sequences of HBV dsRNAs

| Duplex Name | Sense Oligo Name | Sense Sequence (5' to 3') | SEQ ID NO: | Antisense Oligo Name | Antisense Sequence (5' to 3') | SEQ ID NO: | Position in NC_003977.1 |
|---|---|---|---|---|---|---|---|
| AD-64319.1 | A-128423.2 | ACUGUUCAAGCCUCCAAGCUA | 258 | A-128477.1 | UAGCUUGGAGGCUUGAACAAGAC | 693 | 1857_1879 |
| AD-64320.1 | A-128435.2 | UCUGCCGAUCCAUACUGCGGA | 259 | A-128483.1 | UCCGCAGUAUGGAUCGGCAGAGG | 694 | 1255_1277 |
| AD-64321.1 | A-123463.3 | AGUUAUAUGGAUGAUGUGGUA | 260 | A-128446.1 | UACCACAUCAUCCAUAUAACUGA | 695 | 731_753 |
| AD-64322.1 | A-128379.2 | AUGUGUCUGCGGCGUUUUAUA | 261 | A-128454.1 | UAUAAAACGCCGCAGACACAUCC | 696 | 375_397 |
| AD-64323.1 | A-128395.2 | CCCCGUCUGUGCCUUCUCAUA | 262 | A-128462.1 | UAUGAGAAGGCACAGACGGGGAG | 697 | 1545_1567 |
| AD-64324.1 | A-128409.2 | GCCUAAUCAUCUCUUGUUCAU | 263 | A-128470.1 | AUGAACAAGAGAUGAUUAGCGAG | 698 | 1831_1853 |
| AD-64325.1 | A-128425.2 | UCUAGACUCGUGGUGGACUUC | 264 | A-128478.1 | GAAGUCCACCACGAGUCUAGACU | 699 | 245_267 |
| AD-64326.1 | A-128437.2 | CUGCCGAUCCAUACUGCGGAA | 265 | A-128484.1 | UUCCGCAGUAUGGAUCGGCAGAG | 700 | 1256_1278 |
| AD-64328.1 | A-128381.2 | AUCUUCUUGUUGGUUCUUCUA | 266 | A-128455.1 | UAGAAGAACCAACAAGAAGAUGA | 701 | 426_448 |
| AD-64330.1 | A-128411.2 | UUCUCUCAAUUUCUAGGGGA | 267 | A-128471.1 | UCCCCUAGAAAUUGAGAGAAGU | 702 | 263_285 |
| AD-64331.1 | A-127905.16 | ACUCGUGGUGGACUUCUCUCA | 268 | A-127907.2 | UGAGAGAAGUCCACCACGAGUCU | 703 | 250_272 |
| AD-64332.1 | A-128001.3 | GUGCACUUCGCUUCACCUCUG | 269 | A-128485.1 | CAGAGGUGAAGCGAAGUGCACAC | 704 | 1577_1599 |
| AD-64333.1 | A-128367.2 | GUUUUUCUUGUUGACAAAAAU | 270 | A-128448.1 | AUUUUUGUCAACAAGAAAAACCC | 705 | 206_228 |
| AD-64334.1 | A-128383.2 | CUGCCUAAUCAUCUCUUGUUA | 271 | A-128456.1 | UAACAAGAGAUGAUUAGGCAGAG | 706 | 1829_1851 |
| AD-64335.1 | A-128399.2 | UCCUCACAAUACCACAGAGUA | 272 | A-128464.1 | UACUCUGUGGUAUUGUGAGGAUU | 707 | 226_248 |
| AD-64336.1 | A-128413.2 | CUUGUUGACAAAAAUCCUCAA | 273 | A-128472.1 | UUGAGGAUUUUUGUCAACAAGAA | 708 | 212_234 |
| AD-64337.1 | A-127955.16 | GUGGUGGACUUCUCUCAAUUU | 274 | A-127958.2 | AAAUUGAGAGAAGUCCACCACGA | 709 | 254_276 |
| AD-64338.1 | A-128439.2 | GCAACUUUUUCACCUCUGCCU | 275 | A-128486.1 | AGGCAGAGGUGAAAAAGUUGCAU | 710 | 1814_1836 |
| AD-64339.1 | A-128369.2 | GGGAACAAGAGCUACAGCAUA | 276 | A-128449.1 | UAUGCUGUAGCUCUUGUUCCCAA | 711 | 2828_2850 |
| AD-64341.1 | A-128401.2 | UCAUCUUCUUGUUGGUUCUUA | 277 | A-128465.1 | UAAGAACCAACAAGAAGAUGAGG | 712 | 424_446 |
| AD-64342.1 | A-128415.2 | CUGCUGCUAUGCCUCAUCUUA | 278 | A-128473.1 | UAAGAUGAGGCAUAGCAGCAGGA | 713 | 411_433 |
| AD-64343.1 | A-128427.2 | GUUGGAUGUGUCUGCGGCGUU | 279 | A-128479.1 | AACGCCGCAGACACAUCCAACGA | 714 | 370_392 |
| AD-64344.1 | A-128441.2 | UUCAUCCUGCUGCUAUGCCUA | 280 | A-128487.1 | UAGGCAUAGCAGCAGGAUGAAGA | 715 | 405_427 |
| AD-64345.1 | A-128371.2 | UUCUUGUUGACAAAAAUCCUA | 281 | A-128450.1 | UAGGAUUUUUGUCAACAAGAAAA | 716 | 210_232 |
| AD-64347.1 | A-123487.3 | GGAUGUGUCUGCGGCGUUUUA | 282 | A-128466.1 | UAAAACGCCGCAGACACAUCCAG | 717 | 373_395 |
| AD-64348.1 | A-128417.2 | UAUAUGGAUGAUGUGGUAUUA | 283 | A-128474.1 | UAAUACCACAUCAUCCAUAUAAC | 718 | 734_756 |
| AD-64349.1 | A-128429.2 | UUCAUCCUGCUGCUAUGCCUC | 284 | A-128480.1 | GAGGCAUAGCAGCAGGAUGAAGA | 719 | 405_427 |
| AD-64350.1 | A-128443.2 | GUGCACUUCGCUUCACCUCUA | 285 | A-128488.1 | UAGAGGUGAAGCGAAGUGCACAC | 720 | 1577_1599 |
| AD-64351.1 | A-128373.2 | UUGACAAAAAUCCUCACAAUA | 286 | A-128451.1 | UAUUGUGAGGAUUUUUGUCAACA | 721 | 216_238 |
| AD-64352.1 | A-128389.2 | CCAAGUGUUUGCUGACGCAAA | 287 | A-128459.1 | UUUGCGUCAGCAAACACUUGGCA | 722 | 1174_1196 |
| AD-64352.1 | A-128389.2 | CCAAGUGUUUGCUGACGCAAA | 288 | A-128459.1 | UUUGCGUCAGCAAACACUUGGCA | 723 | 1174_1196 |
| AD-64353.1 | A-128403.2 | AAGCCUCCAAGCUGUGCCUUA | 289 | A-128467.1 | UAAGGCACAGCUUGGAGGCUUGA | 724 | 1864_1886 |
| AD-64354.1 | A-128419.2 | CCUCUUCAUCCUGCUGCUAUA | 290 | A-128475.1 | UAUAGCAGCAGGAUGAAGAGGAA | 725 | 401_423 |
| AD-64355.1 | A-128431.2 | CCUGCUGCUAUGCCUCAUCUU | 291 | A-128481.1 | AAGAUGAGGCAUAGCAGCAGGAU | 726 | 410_432 |
| AD-64356.1 | A-128375.2 | CAUCUUCUUGUUGGUUCUUCU | 292 | A-128452.1 | AGAAGAACCAACAAGAAGAUGAG | 727 | 425_447 |
| AD-64357.1 | A-128391.2 | CCGUCUGUGCCUUCUCAUCUA | 293 | A-128460.1 | UAGAUGAGAAGGCACAGACGGGG | 728 | 1547_1569 |
| AD-64358.1 | A-128405.2 | CCUCAUCUUCUUGUUGGUUCU | 294 | A-128468.1 | AGAACCAACAAGAAGAUGAGGCA | 729 | 422_444 |

TABLE 3-continued

Unmodified Sense and Antisense Strand Sequences of HBV dsRNAs

| Duplex Name | Sense Oligo Name | Sense Sequence (5' to 3') | SEQ ID NO: | Antisense Oligo Name | Antisense Sequence (5' to 3') | SEQ ID NO: | Position in NC_003977.1 |
|---|---|---|---|---|---|---|---|
| AD-64359.1 | A-128421.2 | CCACCAAAUGCCCCUAUCUUA | 295 | A-128476.1 | UAAGAUAGGGGCAUUUGGUGGUC | 730 | 2298_2320 |
| AD-64360.1 | A-128433.2 | GCUCCUCUGCCGAUCCAUACU | 296 | A-128482.1 | AGUAUGGAUCGGCAGAGGAGCCA | 731 | 1250_1272 |
| AD-64700.1 | A-129379.1 | ACUCGUGGUGUACUUCUCUCA | 297 | A-127906.26 | UGAGAGAAGUCCACCACGAGUCU | 732 | 250_272 |
| AD-64701.1 | A-127905.20 | ACUCGUGGUGGACUUCUCUCA | 298 | A-129387.1 | UGAGAGAAGTCCACCACGAGUCU | 733 | 250_272 |
| AD-64702.1 | A-127905.28 | ACUCGUGGUGGACUUCUCUCA | 299 | A-129395.1 | UGAGAGAAGUCCACCACGAGUCU | 734 | 250_272 |
| AD-64703.1 | A-129376.2 | ACUCGUGGUGGACUUCACUCA | 300 | A-129385.5 | UGAGAGAAGTCCACCACGAGUCU | 735 | 250_272 |
| AD-64704.1 | A-129381.3 | ACUCGUGGUGUACUUCACUCA | 301 | A-129389.6 | UGAGAGAAGUCCACCACGAGUCU | 736 | 250_272 |
| AD-64705.1 | A-129380.1 | ACUCGUGGUGUACUUCACUCA | 302 | A-127906.27 | UGAGAGAAGUCCACCACGAGUCU | 737 | 250_272 |
| AD-64706.1 | A-127905.21 | ACUCGUGGUGGACUUCUCUCA | 303 | A-129388.1 | UGAGAGAAGUCCACCACGAGUCU | 738 | 250_272 |
| AD-64707.1 | A-127905.29 | ACUCGUGGUGGACUUCUCUCA | 304 | A-129396.1 | UGAGAGAAGTCCACCACGAGUCU | 739 | 250_272 |
| AD-64708.1 | A-129382.2 | ACUCGUGGTGGACUUCUCUCA | 305 | A-129385.6 | UGAGAGAAGTCCACCACGAGUCU | 740 | 250_272 |
| AD-64709.1 | A-129373.4 | ACUCGUGGUGGACUUCUCUCA | 306 | A-129391.2 | UGAGAGAAGUCCACCACGAGUCU | 741 | 250_272 |
| AD-64710.1 | A-129373.1 | ACUCGUGGUGGACUUCUCUCA | 307 | A-127906.20 | UGAGAGAAGUCCACCACGAGUCU | 742 | 250_272 |
| AD-64711.1 | A-129381.1 | ACUCGUGGTGUACUUCACUCA | 308 | A-127906.28 | UGAGAGAAGUCCACCACGAGUCU | 743 | 250_272 |
| AD-64712.1 | A-127905.22 | ACUCGUGGUGGACUUCUCUCA | 309 | A-129389.1 | UGAGAGAAGUCCACCACGAGUCU | 744 | 250_272 |
| AD-64713.1 | A-127905.30 | ACUCGUGGUGGACUUCUCUCA | 310 | A-129397.1 | UGAGAGAAGUCCACCACGAGUCU | 745 | 250_272 |
| AD-64714.1 | A-129384.2 | ACUCGUGGTGGACUUCACUCA | 311 | A-129385.7 | UGAGAGAAGTCCACCACGAGUCU | 746 | 250_272 |
| AD-64715.1 | A-129376.4 | ACUCGUGGUGGACUUCACUCA | 312 | A-129391.3 | UGAGAGAAGTCCACCACGAGUCU | 747 | 250_272 |
| AD-64716.1 | A-129374.1 | ACUCGUGGUGGACUUCUCUCA | 313 | A-127906.21 | UGAGAGAAGUCCACCACGAGUCU | 748 | 250_272 |
| AD-64717.1 | A-129382.1 | ACUCGUGGTGGACUUCUCUCA | 314 | A-127906.29 | UGAGAGAAGUCCACCACGAGUCU | 749 | 250_272 |
| AD-64718.1 | A-127905.23 | ACUCGUGGUGGACUUCUCUCA | 315 | A-129390.1 | UGAGAGAAGUCCACCACGAGUCU | 750 | 250_272 |
| AD-64719.1 | A-127917.5 | ACUCGUGGUGGACUUCUCUCA | 316 | A-129385.2 | UGAGAGAAGTCCACCACGAGUCU | 751 | 250_272 |
| AD-64720.1 | A-129381.2 | ACUCGUGGTGUACUUCACUCA | 317 | A-129385.8 | UGAGAGAAGTCCACCACGAGUCU | 752 | 250_272 |
| AD-64721.1 | A-129382.4 | ACUCGUGGTGGACUUCUCUCA | 318 | A-129391.4 | UGAGAGAAGTCCACCACGAGUCU | 753 | 250_272 |
| AD-64722.1 | A-129375.1 | ACUCGUGGUGGACUUCCUCA | 319 | A-127906.22 | UGAGAGAAGUCCACCACGAGUCU | 754 | 250_272 |
| AD-64723.1 | A-129383.1 | ACUCGUGGUGGACUUCUCUCA | 320 | A-127906.30 | UGAGAGAAGUCCACCACGAGUCU | 755 | 250_272 |
| AD-64725.1 | A-127917.6 | ACUCGUGGUGGACUUCUCUCA | 321 | A-129398.1 | UGAGAGAAGTCCACCACGAGUCU | 756 | 250_272 |
| AD-64726.1 | A-129373.3 | ACUCGUGGUGGACUUCUCUCA | 322 | A-129389.2 | UGAGAGAAGUCCACCACGAGUCU | 757 | 250_272 |
| AD-64727.1 | A-129384.4 | ACUCGUGGTGGACUUCACUCA | 323 | A-129391.5 | UGAGAGAAGTCCACCACGAGUCU | 758 | 250_272 |
| AD-64728.1 | A-129376.1 | ACUCGUGGUGGACUUCACUCA | 324 | A-127906.23 | UGAGAGAAGUCCACCACGAGUCU | 759 | 250_272 |
| AD-64729.1 | A-129384.1 | ACUCGUGGTGGACUUCACUCA | 325 | A-127906.31 | UGAGAGAAGUCCACCACGAGUCU | 760 | 250_272 |
| AD-64730.1 | A-127905.25 | ACUCGUGGUGGACUUCUCUCA | 326 | A-129392.1 | UGAGAGAAGTCCACCACGAGUCU | 761 | 250_272 |
| AD-64731.1 | A-129399.1 | ACUCGUGGUGGACUUCUCUCA | 327 | A-129385.3 | UGAGAGAAGTCCACCACGAGUCU | 762 | 250_272 |
| AD-64732.1 | A-129376.3 | ACUCGUGGUGGACUUCACUCA | 328 | A-129389.3 | UGAGAGAAGUCCACCACGAGUCU | 763 | 250_272 |
| AD-64733.1 | A-129381.4 | ACUCGUGGTGUACUUCACUCA | 329 | A-129391.6 | UGAGAGAAGTCCACCACGAGUCU | 764 | 250_272 |
| AD-64734.1 | A-129377.1 | ACUCGUGGUGGACUUCCUCA | 330 | A-127906.24 | UGAGAGAAGUCCACCACGAGUCU | 765 | 250_272 |
| AD-64735.1 | A-127905.18 | ACUCGUGGUGGACUUCUCUCA | 331 | A-129385.1 | UGAGAGAAGTCCACCACGAGUCU | 766 | 250_272 |

TABLE 3-continued

Unmodified Sense and Antisense Strand Sequences of HBV dsRNAs

| Duplex Name | Sense Oligo Name | Sense Sequence (5' to 3') | SEQ ID NO: | Antisense Oligo Name | Antisense Sequence (5' to 3') | SEQ ID NO: | Position in NC_003977.1 |
|---|---|---|---|---|---|---|---|
| AD-64736.1 | A-127905.26 | ACUCGUGGUGGACUUCUCUCA | 332 | A-129393.1 | UGAGAGAAGTCCACCACGAGUCU | 767 | 250_272 |
| AD-64737.1 | A-129399.2 | ACUCGUGGUGGACUUCTCUCA | 333 | A-129398.2 | UGAGAGAAGTCCACCACGAGUCU | 768 | 250_272 |
| AD-64738.1 | A-129382.3 | ACUCGUGGTGGACUUCTCUCA | 334 | A-129389.4 | UGAGAGAAGUCCACCACGAGUCU | 769 | 250_272 |
| AD-64739.1 | A-129378.1 | ACUCGUGGUGGACUUCGCUCA | 335 | A-127906.25 | UGAGAGAAGUCCACCACGAGUCU | 770 | 250_272 |
| AD-64740.1 | A-127905.19 | ACUCGUGGUGGACUUCUCUCA | 336 | A-129386.1 | UGAGAGAAGTCCACCACGAGUCU | 771 | 250_272 |
| AD-64741.1 | A-127905.27 | ACUCGUGGUGGACUUCUCUCA | 337 | A-129394.1 | UGAGAGAAGTCCACCACGAGUCU | 772 | 250_272 |
| AD-64742.1 | A-129373.2 | ACUCGUGGUGGACUUCUCUCA | 338 | A-129385.4 | UGAGAGAAGTCCACCACGAGUCU | 773 | 250_272 |
| AD-64743.1 | A-129384.3 | ACUCGUGGTGGACUUCACUCA | 339 | A-129389.5 | UGAGAGAAGUCCACCACGAGUCU | 774 | 250_272 |
| AD-61522.2 | A-123463.2 | AGUUAUAUGGAUGAUGUGGUA | 340 | A-123464.2 | UACCACAUCAUCCAUAUAACUGA | 775 | 731_753 |
| AD-61547.2 | A-123487.2 | GGAUGUGUCUGCGGCGUUUUA | 341 | A-123488.2 | UAAAACGCCGCAGACACAUCCAG | 776 | 373_395 |
| AD-63938.2 | A-127896.1 | ACUCGUGGUGGACUUCUCUCA | 342 | A-127897.1 | UGAGAGAAGUCCACCACGAGUCU | 777 | 250_272 |
| AD-63939.2 | A-127909.1 | ACUCGUGGUGGACUUCUCUCA | 343 | A-127906.3 | UGAGAGAAGUCCACCACGAGUCU | 778 | 250_272 |
| AD-63940.2 | A-127917.1 | ACUCGUGGUGGACUUCTCUCA | 344 | A-127906.11 | UGAGAGAAGUCCACCACGAGUCU | 779 | 250_272 |
| AD-63941.2 | A-127905.8 | ACUCGUGGUGGACUUCUCUCA | 345 | A-127925.1 | UGAGAGAAGUCCACCACGAGUCU | 780 | 250_272 |
| AD-63942.2 | A-127933.1 | UCGUGGUGGACUUCUCUCA | 346 | A-127934.1 | UGAGAGAAGUCCACCACGAGU | 781 | 252_274 |
| AD-63943.2 | A-127944.2 | ACUCGUGGUGGACUUCUCUCA | 347 | A-127942.2 | UGAGAGAAGUCCACCACGAGUCU | 782 | 250_272 |
| AD-63945.2 | A-127910.1 | ACUCGUGGUGGACUUCUCUCA | 348 | A-127906.4 | UGAGAGAAGUCCACCACGAGUCU | 783 | 250_272 |
| AD-63946.2 | A-127918.1 | ACUCGUGGUGGACUUCUCUCA | 349 | A-127906.12 | UGAGAGAAGUCCACCACGAGUCU | 784 | 250_272 |
| AD-63947.2 | A-127905.9 | ACUCGUGGUGGACUUCUCUCA | 350 | A-127926.1 | UGAGAGAAGUCCACCACGAGUCU | 785 | 250_272 |
| AD-63948.2 | A-127935.1 | GUGGUGGACUUCUCUCA | 351 | A-127936.1 | UGAGAGAAGUCCACCACGA | 786 | 254_276 |
| AD-63949.2 | A-127944.3 | ACUCGUGGUGGACUUCUCUCA | 352 | A-127906.14 | UGAGAGAAGUCCACCACGAGUCU | 787 | 250_272 |
| AD-63950.2 | A-127900.1 | UCGUGGUGGACUUCUCUCAUU | 353 | A-127901.1 | UGAGAGAAGUCCACCACGAUU | 788 | 252_274 |
| AD-63951.2 | A-127911.1 | ACUCGUGGUGGACUUCUCUCA | 354 | A-127906.5 | UGAGAGAAGUCCACCACGAGUCU | 789 | 250_272 |
| AD-63952.2 | A-127905.2 | ACUCGUGGUGGACUUCUCUCA | 355 | A-127919.1 | UGAGAGAAGUCCACCACGAGUCU | 790 | 250_272 |
| AD-63953.2 | A-127905.10 | ACUCGUGGUGGACUUCUCUCA | 356 | A-127927.1 | UGAGAGAAGUCCACCACGAGUCU | 791 | 250_272 |
| AD-63955.2 | A-127945.1 | ACUCGUGGUGGACUUCUCUCA | 357 | A-127940.3 | UGAGAGAAGUCCACCACGAGUCU | 792 | 250_272 |
| AD-63956.2 | A-127902.1 | UCGUGGUGGACUUCUCUCA | 358 | A-127903.1 | UGAGAGAAGUCCACCACGAUU | 793 | 252_274 |
| AD-63957.2 | A-127912.1 | ACUCGUGGUGGACUUCUCUCA | 359 | A-127906.6 | UGAGAGAAGUCCACCACGAGUCU | 794 | 250_272 |
| AD-63958.2 | A-127905.3 | ACUCGUGGUGGACUUCUCUCA | 360 | A-127920.1 | UGAGAGAAGUCCACCACGAGUCU | 795 | 250_272 |
| AD-63959.2 | A-127905.11 | ACUCGUGGUGGACUUCUCUCA | 361 | A-127928.1 | UGAGAGAAGUCCACCACGAGUCU | 796 | 250_272 |
| AD-63960.2 | A-126619.2 | UAUUCCUAGGGUACAA | 362 | A-127938.1 | UGAGAGAAGUCCACCACGA | 797 | 254_276 |
| AD-63961.2 | A-127945.2 | ACUCGUGGUGGACUUCUCUCA | 363 | A-127942.3 | UGAGAGAAGUCCACCACGAGUCU | 798 | 250_272 |
| AD-63962.2 | A-127902.2 | UCGUGGUGGACUUCUCUCA | 364 | A-127904.1 | UGAGAGAAGUCCACCACGAUU | 799 | 252_274 |
| AD-63963.2 | A-127913.1 | ACUCGUGGUGGACUUCUCUCA | 365 | A-127906.7 | UGAGAGAAGUCCACCACGAGUCU | 800 | 250_272 |
| AD-63964.2 | A-127905.4 | ACUCGUGGUGGACUUCUCUCA | 366 | A-127921.1 | UGAGAGAAGUCCACCACGAGUCU | 801 | 250_272 |
| AD-63965.2 | A-127905.12 | ACUCGUGGUGGACUUCUCUCA | 367 | A-127929.1 | UGAGAGAAGUCCACCACGAGUCU | 802 | 250_272 |
| AD-63966.2 | A-127939.1 | ACUCGUGGUGGACUUCUCUCA | 368 | A-127940.1 | UGAGAGAAGUCCACCACGAGUCU | 803 | 250_272 |

TABLE 3-continued

Unmodified Sense and Antisense Strand Sequences of HBV dsRNAs

| Duplex Name | Sense Oligo Name | Sense Sequence (5' to 3') | SEQ ID NO: | Antisense Oligo Name | Antisense Sequence (5' to 3') | SEQ ID NO: | Position in NC_003977.1 |
|---|---|---|---|---|---|---|---|
| AD-63967.2 | A-127945.3 | ACUCGUGGUGGACUUCUCUCA | 369 | A-127906.15 | UGAGAGAAGUCCACCACGAGUCU | 804 | 250_272 |
| AD-63968.2 | A-127905.1 | ACUCGUGGUGGACUUCUCUCA | 370 | A-127906.1 | UGAGAGAAGUCCACCACGAGUCU | 805 | 250_272 |
| AD-63968.4 | A-127905.15 | ACUCGUGGUGGACUUCUCUCA | 371 | A-127906.17 | UGAGAGAAGUCCACCACGAGUCU | 806 | 250_272 |
| AD-63968.5 | A-127905.17 | ACUCGUGGUGGACUUCUCUCA | 372 | A-127906.18 | UGAGAGAAGUCCACCACGAGUCU | 807 | 250_272 |
| AD-63969.2 | A-127914.1 | ACUCGUGGUGGACUUCUCUCA | 373 | A-127906.8 | UGAGAGAAGUCCACCACGAGUCU | 808 | 250_272 |
| AD-63970.2 | A-127905.5 | ACUCGUGGUGGACUUCUCUCA | 374 | A-127922.1 | UGAGAGAAGUCCACCACGAGUCU | 809 | 250_272 |
| AD-63971.2 | A-127905.13 | ACUCGUGGUGGACUUCUCUCA | 375 | A-127930.1 | UGAGAGAAGUCCACCACGAGUCU | 810 | 250_272 |
| AD-63972.2 | A-127941.1 | ACUCGUGGUGGACUUCUCUCA | 376 | A-127942.1 | UGAGAGAAGUCCACCACGAGUCU | 811 | 250_272 |
| AD-63973.2 | A-127946.1 | ACUCGUGGUGGACUUCUCUCA | 377 | A-127947.1 | UGAGAGAAGTCCACCACGAGUCU | 812 | 250_272 |
| AD-63975.2 | A-127915.1 | ACUCGUGGUGGACUUCTCUCA | 378 | A-127906.9 | UGAGAGAAGUCCACCACGAGUCU | 813 | 250_272 |
| AD-63976.2 | A-127905.6 | ACUCGUGGUGGACUUCUCUCA | 379 | A-127923.1 | UGAGAGAAGUCCACCACGAGUCU | 814 | 250_272 |
| AD-63977.2 | A-127917.2 | ACUCGUGGUGGACUUCTCUCA | 380 | A-127931.1 | UGAGAGAAGUCCACCACGAGUCU | 815 | 250_272 |
| AD-63978.2 | A-127943.1 | ACUCGUGGUGGACUUCUCUCA | 381 | A-127906.13 | UGAGAGAAGUCCACCACGAGUCU | 816 | 250_272 |
| AD-63979.2 | A-127908.1 | ACUCGUGGUGGACUUCUCUCA | 382 | A-127906.2 | UGAGAGAAGUCCACCACGAGUCU | 817 | 250_272 |
| AD-63980.2 | A-127916.1 | ACUCGUGGUGGACUUCTCUCA | 383 | A-127906.10 | UGAGAGAAGUCCACCACGAGUCU | 818 | 250_272 |
| AD-63981.2 | A-127905.7 | ACUCGUGGUGGACUUCUCUCA | 384 | A-127924.1 | UGAGAGAAGUCCACCACGAGUCU | 819 | 250_272 |
| AD-63982.2 | A-127917.3 | ACUCGUGGUGGACUUCTCUCA | 385 | A-127932.1 | UGAGAGAAGUCCACCACGAGUCU | 820 | 250_272 |
| AD-63983.2 | A-127944.1 | ACUCGUGGUGGACUUCUCUCA | 386 | A-127940.2 | UGAGAGAAGUCCACCACGAGUCU | 821 | 250_272 |
| AD-63985.2 | A-127961.1 | GUGGUGGACUUCUCUCAAUUU | 387 | A-127956.4 | AAAUUGAGAGAAGUCCACCACGA | 822 | 254_276 |
| AD-63986.2 | A-127969.1 | GUGGUGGACUUCUCUCAAUUU | 388 | A-127956.12 | AAAUUGAGAGAAGUCCACCACGA | 823 | 254_276 |
| AD-63987.2 | A-127955.9 | GUGGUGGACUUCUCUCAAUUU | 389 | A-127977.1 | AAAUUGAGAGAAGUCCACCACGA | 824 | 254_276 |
| AD-63988.2 | A-127986.1 | UGGACUUCUCUCAAUUU | 390 | A-127987.1 | AAAUUGAGAGAAGUCCACC | 825 | 258_280 |
| AD-63989.2 | A-127996.1 | GUGGUGGACUUCUCUCAAUUU | 391 | A-127992.2 | AAAUUGAGAGAAGUCCACCACGA | 826 | 254_276 |
| AD-63990.2 | A-127950.1 | GGUGGACUUCUCUCAAUUUUU | 392 | A-127951.1 | AAAUUGAGAGAAGUCCACCUU | 827 | 256_278 |
| AD-63991.2 | A-127962.1 | GUGGUGGACUUCUCUCAAUUU | 393 | A-127956.5 | AAAUUGAGAGAAGUCCACCACGA | 828 | 254_276 |
| AD-63992.2 | A-127955.2 | GUGGUGGACUUCUCUCAAUUU | 394 | A-127970.1 | AAAUUGAGAGAAGUCCACCACGA | 829 | 254_276 |
| AD-63993.2 | A-127955.10 | GUGGUGGACUUCUCUCAAUUU | 395 | A-127978.1 | AAAUUGAGAGAAGUCCACCACGA | 830 | 254_276 |
| AD-63994.2 | A-127984.2 | GGUGGACUUCUCUCAAUUU | 396 | A-127988.1 | AAAUUGAGAGAAGUCCACCAC | 831 | 256_278 |
| AD-63995.2 | A-127996.2 | GUGGUGGACUUCUCUCAAUUU | 397 | A-127993.2 | AAAUUGAGAGAAGUCCACCACGA | 832 | 254_276 |
| AD-63996.2 | A-127952.1 | GGUGGACUUCUCUCAAUUU | 398 | A-127953.1 | AAAUUGAGAGAAGUCCACCUU | 833 | 256_278 |
| AD-63997.2 | A-127963.1 | GUGGUGGACUUCUCUCAAUUU | 399 | A-127956.6 | AAAUUGAGAGAAGUCCACCACGA | 834 | 254_276 |
| AD-63999.2 | A-127955.11 | GUGGUGGACUUCUCUCAAUUU | 400 | A-127979.1 | AAAUUGAGAGAAGUCCACCACGA | 835 | 254_276 |
| AD-64000.2 | A-127986.2 | UGGACUUCUCUCAAUUU | 401 | A-127989.1 | AAAUUGAGAGAAGUCCACC | 836 | 258_280 |
| AD-64001.2 | A-127996.3 | GUGGUGGACUUCUCUCAAUUU | 402 | A-127994.2 | AAAUUGAGAGAAGUCCACCACGA | 837 | 254_276 |
| AD-64002.2 | A-127952.2 | GGUGGACUUCUCUCAAUUU | 403 | A-127954.1 | AAAUUGAGAGAAGUCCACCUU | 838 | 256_278 |
| AD-64003.2 | A-127964.1 | GUGGUGGACUUCUCUCAAUUU | 404 | A-127956.7 | AAAUUGAGAGAAGUCCACCACGA | 839 | 254_276 |
| AD-64004.2 | A-127955.4 | GUGGUGGACUUCUCUCAAUUU | 405 | A-127972.1 | AAAUUGAGAGAAGUCCACCACGA | 840 | 254_276 |

TABLE 3-continued

Unmodified Sense and Antisense Strand Sequences of HBV dsRNAs

| Duplex Name | Sense Oligo Name | Sense Sequence (5' to 3') | SEQ ID NO: | Antisense Oligo Name | Antisense Sequence (5' to 3') | SEQ ID NO: | Position in NC_003977.1 |
|---|---|---|---|---|---|---|---|
| AD-64005.2 | A-127955.12 | GUGGUGGACUUCUCUCAAUUU | 406 | A-127980.1 | AAAUUGAGAGAAGUCCACCACGA | 841 | 254_276 |
| AD-64006.2 | A-127990.1 | GUGGUGGACUUCUCUCAAUUU | 407 | A-127991.1 | AAAUUGAGAGAAGUCCACCACGA | 842 | 254_276 |
| AD-64007.2 | A-127996.4 | GUGGUGGACUUCUCUCAAUUU | 408 | A-127995.2 | AAAUUGAGAGAAGUCCACCACGA | 843 | 254_276 |
| AD-64008.2 | A-127955.1 | GUGGUGGACUUCUCUCAAUUU | 409 | A-127956.1 | AAAUUGAGAGAAGUCCACCACGA | 844 | 254_276 |
| AD-64008.4 | A-127955.15 | GUGGUGGACUUCUCUCAAUUU | 410 | A-127956.14 | AAAUUGAGAGAAGUCCACCACGA | 845 | 254_276 |
| AD-64009.2 | A-127965.1 | GUGGUGGACUUCUCUCAAUUU | 411 | A-127956.8 | AAAUUGAGAGAAGUCCACCACGA | 846 | 254_276 |
| AD-64010.2 | A-127955.5 | GUGGUGGACUUCUCUCAAUUU | 412 | A-127973.1 | AAAUUGAGAGAAGUCCACCACGA | 847 | 254_276 |
| AD-64011.2 | A-127955.13 | GUGGUGGACUUCUCUCAAUUU | 413 | A-127981.1 | AAAUUGAGAGAAGUCCACCACGA | 848 | 254_276 |
| AD-64012.2 | A-127990.2 | GUGGUGGACUUCUCUCAAUUU | 414 | A-127992.1 | AAAUUGAGAGAAGUCCACCACGA | 849 | 254_276 |
| AD-64013.2 | A-127997.1 | GUGGUGGACTTCUCUCAAUUU | 415 | A-127998.1 | AAAUUGAGAGAAGTCCACCACGA | 850 | 254_276 |
| AD-64014.2 | A-127957.1 | GUGGUGGACUUCUCUCAAUUU | 416 | A-127958.1 | AAAUUGAGAGAAGUCCACCACGA | 851 | 254_276 |
| AD-64015.2 | A-127966.1 | GUGGUGGACUUCUCUCAAUUU | 417 | A-127956.9 | AAAUUGAGAGAAGUCCACCACGA | 852 | 254_276 |
| AD-64016.2 | A-127955.6 | GUGGUGGACUUCUCUCAAUUU | 418 | A-127974.1 | AAAUUGAGAGAAGUCCACCACGA | 853 | 254_276 |
| AD-64017.2 | A-127968.2 | GUGGUGGACUTCUCUCAAUUU | 419 | A-127982.1 | AAAUUGAGAGAAGTCCACCACGA | 854 | 254_276 |
| AD-64018.2 | A-127990.3 | GUGGUGGACUUCUCUCAAUUU | 420 | A-127993.1 | AAAUUGAGAGAAGUCCACCACGA | 855 | 254_276 |
| AD-64019.2 | A-127959.1 | GUGGUGGACUUCUCUCAAUUU | 421 | A-127956.2 | AAAUUGAGAGAAGUCCACCACGA | 856 | 254_276 |
| AD-64020.2 | A-127967.1 | GUGGUGGACUUCUCUCAAUUU | 422 | A-127956.10 | AAAUUGAGAGAAGUCCACCACGA | 857 | 254_276 |
| AD-64021.2 | A-127955.7 | GUGGUGGACUUCUCUCAAUUU | 423 | A-127975.1 | AAAUUGAGAGAAGUCCACCACGA | 858 | 254_276 |
| AD-64022.2 | A-127968.3 | GUGGUGGACUTCUCUCAAUUU | 424 | A-127983.1 | AAAUUGAGAGAAGTCCACCACGA | 859 | 254_276 |
| AD-64023.2 | A-127990.4 | GUGGUGGACUUCUCUCAAUUU | 425 | A-127994.1 | AAAUUGAGAGAAGUCCACCACGA | 860 | 254_276 |
| AD-64024.2 | A-127960.1 | GUGGUGGACUUCUCUCAAUUU | 426 | A-127956.3 | AAAUUGAGAGAAGUCCACCACGA | 861 | 254_276 |
| AD-64025.2 | A-127968.1 | GUGGUGGACUTCUCUCAAUUU | 427 | A-127956.11 | AAAUUGAGAGAAGUCCACCACGA | 862 | 254_276 |
| AD-64026.2 | A-127955.8 | GUGGUGGACUUCUCUCAAUUU | 428 | A-127976.1 | AAAUUGAGAGAAGUCCACCACGA | 863 | 254_276 |
| AD-64027.2 | A-127984.1 | GGUGGACUUCUCUCAAUUU | 429 | A-127985.1 | AAAUUGAGAGAAGUCCACCAC | 864 | 256_278 |
| AD-64028.2 | A-127990.5 | GUGGUGGACUUCUCUCAAUUU | 430 | A-127995.1 | AAAUUGAGAGAAGUCCACCACGA | 865 | 254_276 |
| AD-64272.2 | A-128001.2 | GUGCACUUCGCUUCACCUCUG | 431 | A-128002.2 | CAGAGGUGAAGCGAAGUGCACAC | 866 | 1577_1599 |
| AD-64274.1 | A-128363.1 | GUUGACAAAAAUCCUCACAAU | 432 | A-128364.1 | AUUGUGAGGAUUUUUGUCAACAA | 867 | 215_237 |
| AD-64275.1 | A-128377.1 | UGUUGACAAAAUCCUCACAA | 433 | A-128378.1 | UUGUGAGGAUUUUUGUCAACAAG | 868 | 214_236 |
| AD-64276.1 | A-128393.1 | GGUGGACUUCUCUCAAUUUUA | 434 | A-128394.1 | UAAAAUUGAGAGAAGUCCACCAC | 869 | 256_278 |
| AD-64277.1 | A-128407.1 | UCUUUUGGAGUGUGGAUUCGA | 435 | A-128408.1 | UCGAAUCCACACUCCAAAAGACA | 870 | 2259_2281 |
| AD-64277.1 | A-128407.1 | UCUUUUGGAGUGUGGAUUCGA | 436 | A-128408.1 | UCGAAUCCACACUCCAAAAGACA | 871 | 2259_2281 |
| AD-64278.1 | A-128423.1 | ACUGUUCAAGCCUCCAAGCUA | 437 | A-128424.1 | UAGCUUGGAGGCUUGAACAAGAC | 872 | 1857_1879 |
| AD-64279.1 | A-128435.1 | UCUGCCGAUCCAUACUGCGGA | 438 | A-128436.1 | UCCGCAGUAUGGAUCGGCAGAGG | 873 | 1255_1277 |
| AD-64280.1 | A-128379.1 | AUGUGUCUGCGGCGUUUUAUA | 439 | A-128380.1 | UAUAAAACGCCGCAGACACAUCC | 874 | 375_397 |
| AD-64281.1 | A-128395.1 | CCCCGUCUGUGCCUUCUCAUA | 440 | A-128396.1 | UAUGAGAAGGCACAGACGGGGAG | 875 | 1545_1567 |
| AD-64282.1 | A-128409.1 | GCCUAAUCAUCUCUUGUUCAU | 441 | A-128410.1 | AUGAACAAGAGAUGAUUAGCGAG | 876 | 1831_1853 |
| AD-64283.1 | A-128425.1 | UCUAGACUCGUGGUGGACUUC | 442 | A-128426.1 | GAAGUCCACCACGAGUCUAGACU | 877 | 245_267 |

TABLE 3-continued

Unmodified Sense and Antisense Strand Sequences of HBV dsRNAs

| Duplex Name | Sense Oligo Name | Sense Sequence (5' to 3') | SEQ ID NO: | Antisense Oligo Name | Antisense Sequence (5' to 3') | SEQ ID NO: | Position in NC_003977.1 |
|---|---|---|---|---|---|---|---|
| AD-64284.1 | A-128437.1 | CUGCCGAUCCAUACUGCGGAA | 443 | A-128438.1 | UUCCGCAGUAUGGAUCGGCAGAG | 878 | 1256_1278 |
| AD-64285.1 | A-128365.1 | UUUUUCUUGUUGACAAAAAUA | 444 | A-128366.1 | UAUUUUUGUCAACAAGAAAAACC | 879 | 207_229 |
| AD-64286.1 | A-128381.1 | AUCUUCUUGUUGGUUCUUCUA | 445 | A-128382.1 | UAGAAGAACCAACAAGAAGAUGA | 880 | 426_448 |
| AD-64289.1 | A-128367.1 | GUUUUUCUUGUUGACAAAAU | 446 | A-128368.1 | AUUUUUGUCAACAAGAAAAACCC | 881 | 206_228 |
| AD-64290.1 | A-128383.1 | CUGCCUAAUCAUCUCUUGUUA | 447 | A-128384.1 | UAACAAGAGAUGAUUAGGCAGAG | 882 | 1829_1851 |
| AD-64291.1 | A-128399.1 | UCCUCACAAUACCACAGAGUA | 448 | A-128400.1 | UACUCUGUGGUAUUGUGAGGAUU | 883 | 226_248 |
| AD-64292.1 | A-128413.1 | CUUGUUGACAAAAAUCCUCAA | 449 | A-128414.1 | UUGAGGAUUUUUGUCAACAAGAA | 884 | 212_234 |
| AD-64293.1 | A-128439.1 | GCAACUUUUUCACCUCUGCCU | 450 | A-128440.1 | AGGCAGAGGUGAAAAAGUUGCAU | 885 | 1814_1836 |
| AD-64294.1 | A-128369.1 | GGGAACAAGAGCUACAGCAUA | 451 | A-128370.1 | UAUGCUGUAGCUCUUGUUCCCAA | 886 | 2828_2850 |
| AD-64295.1 | A-128385.1 | CGUGGUGGACUUCUCUCAAUU | 452 | A-128386.1 | AAUUGAGAGAAGUCCACCAGCAG | 887 | 253_275 |
| AD-64297.1 | A-128415.1 | CUGCUGCUAUGCCUCAUCUUA | 453 | A-128416.1 | UAAGAUGAGGCAUAGCAGCAGGA | 888 | 411_433 |
| AD-64298.1 | A-128427.1 | GUUGGAUGUGUCUGCGGCGUU | 454 | A-128428.1 | AACGCCGCAGACACAUCCAACGA | 889 | 370_392 |
| AD-64299.1 | A-128441.1 | UUCAUCCUGCUGCUAUGCCUA | 455 | A-128442.1 | UAGGCAUAGCAGCAGGAUGAAGA | 890 | 405_427 |
| AD-64300.1 | A-128371.1 | UUCUUGUUGACAAAAAUCCUA | 456 | A-128372.1 | UAGGAUUUUUGUCAACAAGAAAA | 891 | 210_232 |
| AD-64302.1 | A-128417.1 | UAUAUGGAUGAUGUGGUAUUA | 457 | A-128418.1 | UAAUACCACAUCAUCCAUAUAAC | 892 | 734_756 |
| AD-64303.1 | A-128429.1 | UUCAUCCUGCUGCUAUGCCUC | 458 | A-128430.1 | GAGGCAUAGCAGCAGGAUGAAGA | 893 | 405_427 |
| AD-64304.1 | A-128443.1 | GUGCACUUCGCUUCACCUCUA | 459 | A-128444.1 | UAGAGGUGAAGCGAAGUGCACAC | 894 | 1577_1599 |
| AD-64305.1 | A-128373.1 | UUGACAAAAAUCCUCACAAUA | 460 | A-128374.1 | UAUUGUGAGGAUUUUUGUCAACA | 895 | 216_238 |
| AD-64307.1 | A-128403.1 | AAGCCUCCAAGCUGUGCCUUA | 461 | A-128404.1 | UAAGGCACAGCUUGGAGGCUUGA | 896 | 1864_1886 |
| AD-64308.1 | A-128419.1 | CCUCUUCAUCCUGCUGCUAUA | 462 | A-128420.1 | UAUAGCAGCAGGAUGAAGAGGAA | 897 | 401_423 |
| AD-64309.1 | A-128431.1 | CCUGCUGCUAUGCCUCAUCUU | 463 | A-128432.1 | AAGAUGAGGCAUAGCAGCAGGAU | 898 | 410_432 |
| AD-64310.1 | A-128375.1 | CAUCUUCUUGUUGGUUCUUCU | 464 | A-128376.1 | AGAAGAACCAACAAGAAGAUGAG | 899 | 425_447 |
| AD-64311.1 | A-128391.1 | CCGUCUGUGCCUUCUCAUCUA | 465 | A-128392.1 | UAGAUGAGAAGGCACAGACGGGG | 900 | 1547_1569 |
| AD-64312.1 | A-128405.1 | CCUCAUCUUCUUGUUGGUUCU | 466 | A-128406.1 | AGAACCAACAAGAAGAUGAGGCA | 901 | 422_444 |
| AD-64313.1 | A-128421.1 | CCACCAAAUGCCCCUAUCUUA | 467 | A-128422.1 | UAAGAUAGGGGCAUUUGGUGGUC | 902 | 2298_2320 |
| AD-64314.1 | A-128433.1 | GCUCCUCUGCCGAUCCAUACU | 468 | A-128434.1 | AGUAUGGAUCGGCAGAGGAGCCA | 903 | 1250_1272 |
| AD-64315.1 | A-128363.2 | GUUGACAAAAAUCCUCACAAU | 469 | A-128445.1 | AUUGUGAGGAUUUUUGUCAACAA | 904 | 215_237 |
| AD-64316.1 | A-128377.2 | UGUUGACAAAAAUCCUCACAA | 470 | A-128453.1 | UUGUGAGGAUUUUUGUCAACAAG | 905 | 214_236 |
| AD-64317.1 | A-128393.2 | GGUGGACUUCUCUCAAUUUUA | 471 | A-128461.1 | UAAAAUUGAGAGAAGUCCACCAC | 906 | 256_278 |
| AD-64318.1 | A-128407.2 | UCUUUUGGAGUGUGGAUUCGA | 472 | A-128469.1 | UCGAAUCCACACUCCAAAGACA | 907 | 2259_2281 |
| AD-64318.1 | A-128407.2 | UCUUUUGGAGUGUGGAUUCGA | 473 | A-128469.1 | UCGAAUCCACACUCCAAAGACA | 908 | 2259_2281 |
| AD-64319.1 | A-128423.2 | ACUGUUCAAGCCUCCAAGCUA | 474 | A-128477.1 | UAGCUUGGAGGCUUGAACAAGAC | 909 | 1857_1879 |
| AD-64320.1 | A-128435.2 | UCGCCGAUCCAUACUGCGGA | 475 | A-128483.1 | UCCGCAGUAUGGAUCGGCAGAGG | 910 | 1255_1277 |
| AD-64321.1 | A-123463.3 | AGUUAUAUGGAUGAUGUGGUA | 476 | A-128446.1 | UACCACAUCAUCCAUAUAACUGA | 911 | 731_753 |
| AD-64322.1 | A-128379.2 | AUGUGUCUGCGGCGUUUUAUA | 477 | A-128454.1 | UAUAAAACGCCGCAGACACAUCC | 912 | 375_397 |
| AD-64323.1 | A-128395.2 | CCCCGUCUGUGCCUUCUCAUA | 478 | A-128462.1 | UAUGAGAAGGCACAGACGGGGAG | 913 | 1545_1567 |
| AD-64324.1 | A-128409.2 | GCCUAAUCAUCUCUUGUUCAU | 479 | A-128470.1 | AUGAACAAGAGAUGAUUAGCGAG | 914 | 1831_1853 |

TABLE 3-continued

Unmodified Sense and Antisense Strand Sequences of HBV dsRNAs

| Duplex Name | Sense Oligo Name | Sense Sequence (5' to 3') | SEQ ID NO: | Antisense Oligo Name | Antisense Sequence (5' to 3') | SEQ ID NO: | Position in NC_003977.1 |
|---|---|---|---|---|---|---|---|
| AD-64325.1 | A-128425.2 | UCUAGACUCGUGGUGGACUUC | 480 | A-128478.1 | GAAGUCCACCACGAGUCUAGACU | 915 | 245_267 |
| AD-64326.1 | A-128437.2 | CUGCCGAUCCAUACUGCGGAA | 481 | A-128484.1 | UUCCGCAGUAUGGAUCGGCAGAG | 916 | 1256_1278 |
| AD-64328.1 | A-128381.2 | AUCUUCUUGUUGGUUCUUCUA | 482 | A-128455.1 | UAGAAGAACCAACAAGAAGAUGA | 917 | 426_448 |
| AD-64330.1 | A-128411.2 | UUCUCUCAAUUUUCUAGGGGA | 483 | A-128471.1 | UCCCCUAGAAAAUUGAGAGAAGU | 918 | 263_285 |
| AD-64331.1 | A-127905.16 | ACUCGUGGUGGACUUCUCUCA | 484 | A-127907.2 | UGAGAGAAGUCCACCACGAGUCU | 919 | 250_272 |
| AD-64332.1 | A-128001.3 | GUGCACUUCGCUUCACCUCUG | 485 | A-128485.1 | CAGAGGUGAAGCGAAGUGCACAC | 920 | 1577_1599 |
| AD-64333.1 | A-128367.2 | GUUUUUCUUGUUGACAAAAAU | 486 | A-128448.1 | AUUUUUGUCAACAAGAAAAACCC | 921 | 206_228 |
| AD-64334.1 | A-128383.2 | CUGCCUAAUCAUCUCUUGUUA | 487 | A-128456.1 | UAACAAGAGAUGAUUAGGCAGAG | 922 | 1829_1851 |
| AD-64335.1 | A-128399.2 | UCCUCACAAUACCACAGAGUA | 488 | A-128464.1 | UACUCUGUGGUAUUGUGAGGAUU | 923 | 226_248 |
| AD-64336.1 | A-128413.2 | CUUGUUGACAAAAAUCCUCAA | 489 | A-128472.1 | UUGAGGAUUUUUGUCAACAAGAA | 924 | 212_234 |
| AD-64337.1 | A-127955.16 | GUGGUGGACUUCUCUCAAUUU | 490 | A-127958.2 | AAAUUGAGAGAAGUCCACCACGA | 925 | 254_276 |
| AD-64338.1 | A-128439.2 | GCAACUUUUUCACCUCUGCCU | 491 | A-128486.1 | AGGCAGAGGUGAAAAAGUUGCAU | 926 | 1814_1836 |
| AD-64339.1 | A-128369.2 | GGGAACAAGAGCUACAGCAUA | 492 | A-128449.1 | UAUGCUGUAGCUCUUGUUCCCAA | 927 | 2828_2850 |
| AD-64341.1 | A-128401.2 | UCAUCUUCUUGUUGGUUCUUA | 493 | A-128465.1 | UAAGAACCAACAAGAAGAUGAGG | 928 | 424_446 |
| AD-64342.1 | A-128415.2 | CUGCUGCUAUGCCUCAUCUUA | 494 | A-128473.1 | UAAGAUGAGGCAUAGCAGCAGGA | 929 | 411_433 |
| AD-64343.1 | A-128427.2 | GUUGGAUGUGUCUGCGGCGUU | 495 | A-128479.1 | AACGCCGCAGACACAUCCAACGA | 930 | 370_392 |
| AD-64344.1 | A-128441.2 | UUCAUCCUGCUGCUAUGCCUA | 496 | A-128487.1 | UAGGCAUAGCAGCAGGAUGAAGA | 931 | 405_427 |
| AD-64345.1 | A-128371.2 | UUCUUGUUGACAAAAAUCCUA | 497 | A-128450.1 | UAGGAUUUUUGUCAACAAGAAAA | 932 | 210_232 |
| AD-64347.1 | A-123487.3 | GGAUGUGUCUGCGGCGUUUUA | 498 | A-128466.1 | UAAAACGCCGCAGACACAUCCAG | 933 | 373_395 |
| AD-64348.1 | A-128417.2 | UAUAUGGAUGAUGUGGUAUUA | 499 | A-128474.1 | UAAUACCACAUCAUCCAUAUAAC | 934 | 734_756 |
| AD-64349.1 | A-128429.2 | UUCAUCCUGCUGCUAUGCCUC | 500 | A-128480.1 | GAGGCAUAGCAGCAGGAUGAAGA | 935 | 405_427 |
| AD-64350.1 | A-128443.2 | GUGCACUUCGCUUCACCUCUA | 501 | A-128488.1 | UAGAGGUGAAGCGAAGUGCACAC | 936 | 1577_1599 |
| AD-64351.1 | A-128373.2 | UUGACAAAAAUCCUCACAAUA | 502 | A-128451.1 | UAUUGUGAGGAUUUUUGUCAACA | 937 | 216_238 |
| AD-64352.1 | A-128389.2 | CCAAGUGUUUGCUGACGCAAA | 503 | A-128459.1 | UUUGCGUCAGCAAACACUUGGCA | 938 | 1174_1196 |
| AD-64352.1 | A-128389.2 | CCAAGUGUUUGCUGACGCAAA | 504 | A-128459.1 | UUUGCGUCAGCAAACACUUGGCA | 939 | 1174_1196 |
| AD-64353.1 | A-128403.2 | AAGCCUCCAAGCUGUGCCUUA | 505 | A-128467.1 | UAAGGCACAGCUUGGAGGCUUGA | 940 | 1864_1886 |
| AD-64354.1 | A-128419.2 | CCUCUUCAUCCUGCUGCUAUA | 506 | A-128475.1 | UAUAGCAGCAGGAUGAAGAGGAA | 941 | 401_423 |
| AD-64355.1 | A-128431.2 | CCUGCUGCUAUGCCUCAUCUU | 507 | A-128481.1 | AAGAUGAGGCAUAGCAGCAGGAU | 942 | 410_432 |
| AD-64356.1 | A-128375.2 | CAUCUUCUUGUUGGUUCUUCU | 508 | A-128452.1 | AGAAGAACCAACAAGAAGAUGAG | 943 | 425_447 |
| AD-64357.1 | A-128391.2 | CCGUCUGUGCCUUCUCAUCUA | 509 | A-128460.1 | UAGAUGAGAAGGCACAGACGGGG | 944 | 1547_1569 |
| AD-64358.1 | A-128405.2 | CCUCAUCUUCUUGUUGGUUCU | 510 | A-128468.1 | AGAACCAACAAGAAGAUGAGGCA | 945 | 422_444 |
| AD-64359.1 | A-128421.2 | CCACCAAAUGCCCCUAUCUUA | 511 | A-128476.1 | UAAGAUAGGGGCAUUUGGUGGUC | 946 | 2298_2320 |
| AD-64360.1 | A-128433.2 | GCUCCUCUGCCGAUCCAUACU | 512 | A-128482.1 | AGUAUGGAUCGGCAGAGGAGCCA | 947 | 1250_1272 |
| AD-64700.1 | A-129379.1 | ACUCGUGGUGUACUUCUCUCA | 513 | A-127906.26 | UGAGAGAAGUCCACCACGAGUCU | 948 | 250_272 |
| AD-64701.1 | A-127905.20 | ACUCGUGGUGGACUUCUCUCA | 514 | A-129387.1 | UGAGAGAAGTCCACCACGAGUCU | 949 | 250_272 |
| AD-64702.1 | A-127905.28 | ACUCGUGGUGGACUUCUCUCA | 515 | A-129395.1 | UGAGAGAAGUCCACCACGAGUCU | 950 | 250_272 |
| AD-64703.1 | A-129376.2 | ACUCGUGGUGGACUUCACUCA | 516 | A-129385.5 | UGAGAGAAGTCCACCACGAGUCU | 951 | 250_272 |

TABLE 3-continued

Unmodified Sense and Antisense Strand Sequences of HBV dsRNAs

| Duplex Name | Sense Oligo Name | Sense Sequence (5' to 3') | SEQ ID NO: | Antisense Oligo Name | Antisense Sequence (5' to 3') | SEQ ID NO: | Position in NC_003977.1 |
|---|---|---|---|---|---|---|---|
| AD-64704.1 | A-129381.3 | ACUCGUGGTGTACUUCACUCA | 517 | A-129389.6 | UGAGAGAAGUCCACCACGAGUCU | 952 | 250_272 |
| AD-64705.1 | A-129380.1 | ACUCGUGGUGTACUUCACUCA | 518 | A-127906.27 | UGAGAGAAGUCCACCACGAGUCU | 953 | 250_272 |
| AD-64706.1 | A-127905.21 | ACUCGUGGUGGACUUCUCUCA | 519 | A-129388.1 | UGAGAGAAGUCCACCACGAGUCU | 954 | 250_272 |
| AD-64707.1 | A-127905.29 | ACUCGUGGUGGACUUCUCUCA | 520 | A-129396.1 | UGAGAGAAGTCCACCACGAGUCU | 955 | 250_272 |
| AD-64708.1 | A-129382.2 | ACUCGUGGTGGACUUCTCUCA | 521 | A-129385.6 | UGAGAGAAGTCCACCACGAGUCU | 956 | 250_272 |
| AD-64709.1 | A-129373.4 | ACUCGUGGUGGACUUCUCUCA | 522 | A-129391.2 | UGAGAGAAGTCCACCACGAGUCU | 957 | 250_272 |
| AD-64710.1 | A-129373.1 | ACUCGUGGUGGACUUCUCUCA | 523 | A-127906.20 | UGAGAGAAGUCCACCACGAGUCU | 958 | 250_272 |
| AD-64711.1 | A-129381.1 | ACUCGUGGTGTACUUCACUCA | 524 | A-127906.28 | UGAGAGAAGUCCACCACGAGUCU | 959 | 250_272 |
| AD-64712.1 | A-127905.22 | ACUCGUGGUGGACUUCUCUCA | 525 | A-129389.1 | UGAGAGAAGUCCACCACGAGUCU | 960 | 250_272 |
| AD-64713.1 | A-127905.30 | ACUCGUGGUGGACUUCUCUCA | 526 | A-129397.1 | UGAGAGAAGTCCACCACGAGUCU | 961 | 250_272 |
| AD-64714.1 | A-129384.2 | ACUCGUGGTGGACUUCACUCA | 527 | A-129385.7 | UGAGAGAAGTCCACCACGAGUCU | 962 | 250_272 |
| AD-64715.1 | A-129376.4 | ACUCGUGGUGGACUUCACUCA | 528 | A-129391.3 | UGAGAGAAGTCCACCACGAGUCU | 963 | 250_272 |
| AD-64716.1 | A-129374.1 | ACUCGUGGUGGACUUCUCUCA | 529 | A-127906.21 | UGAGAGAAGUCCACCACGAGUCU | 964 | 250_272 |
| AD-64717.1 | A-129382.1 | ACUCGUGGTGGACUUCTCUCA | 530 | A-127906.29 | UGAGAGAAGUCCACCACGAGUCU | 965 | 250_272 |
| AD-64718.1 | A-127905.23 | ACUCGUGGUGGACUUCUCUCA | 531 | A-129390.1 | UGAGAGAAGUCCACCACGAGUCU | 966 | 250_272 |
| AD-64719.1 | A-127917.5 | ACUCGUGGUGGACUUCTCUCA | 532 | A-129385.2 | UGAGAGAAGTCCACCACGAGUCU | 967 | 250_272 |
| AD-64720.1 | A-129381.2 | ACUCGUGGTGTACUUCACUCA | 533 | A-129385.8 | UGAGAGAAGTCCACCACGAGUCU | 968 | 250_272 |
| AD-64721.1 | A-129382.4 | ACUCGUGGTGGACUUCTCUCA | 534 | A-129391.4 | UGAGAGAAGTCCACCACGAGUCU | 969 | 250_272 |
| AD-64722.1 | A-129375.1 | ACUCGUGGUGGACUUCCUCA | 535 | A-127906.22 | UGAGAGAAGUCCACCACGAGUCU | 970 | 250_272 |
| AD-64723.1 | A-129383.1 | ACUCGUGGUGGACUUCTCUCA | 536 | A-127906.30 | UGAGAGAAGUCCACCACGAGUCU | 971 | 250_272 |
| AD-64725.1 | A-127917.6 | ACUCGUGGUGGACUUCTCUCA | 537 | A-129398.1 | UGAGAGAAGTCCACCACGAGUCU | 972 | 250_272 |
| AD-64726.1 | A-129373.3 | ACUCGUGGUGGACUUCUCUCA | 538 | A-129389.2 | UGAGAGAAGUCCACCACGAGUCU | 973 | 250_272 |
| AD-64727.1 | A-129384.4 | ACUCGUGGTGGACUUCACUCA | 539 | A-129391.5 | UGAGAGAAGTCCACCACGAGUCU | 974 | 250_272 |
| AD-64728.1 | A-129376.1 | ACUCGUGGUGGACUUCACUCA | 540 | A-127906.23 | UGAGAGAAGUCCACCACGAGUCU | 975 | 250_272 |
| AD-64729.1 | A-129384.1 | ACUCGUGGTGGACUUCACUCA | 541 | A-127906.31 | UGAGAGAAGUCCACCACGAGUCU | 976 | 250_272 |
| AD-64730.1 | A-127905.25 | ACUCGUGGUGGACUUCUCUCA | 542 | A-129392.1 | UGAGAGAAGTCCACCACGAGUCU | 977 | 250_272 |
| AD-64731.1 | A-129399.1 | ACUCGUGGUGGACUUCTCUCA | 543 | A-129385.3 | UGAGAGAAGTCCACCACGAGUCU | 978 | 250_272 |
| AD-64732.1 | A-129376.3 | ACUCGUGGUGGACUUCACUCA | 544 | A-129389.3 | UGAGAGAAGUCCACCACGAGUCU | 979 | 250_272 |
| AD-64733.1 | A-129381.4 | ACUCGUGGTGTACUUCACUCA | 545 | A-129391.6 | UGAGAGAAGTCCACCACGAGUCU | 980 | 250_272 |
| AD-64734.1 | A-129377.1 | ACUCGUGGUGGACUUCCCUCA | 546 | A-127906.24 | UGAGAGAAGUCCACCACGAGUCU | 981 | 250_272 |
| AD-64735.1 | A-127905.18 | ACUCGUGGUGGACUUCUCUCA | 547 | A-129385.1 | UGAGAGAAGTCCACCACGAGUCU | 982 | 250_272 |
| AD-64736.1 | A-127905.26 | ACUCGUGGUGGACUUCUCUCA | 548 | A-129393.1 | UGAGAGAAGTCCACCACGAGUCU | 983 | 250_272 |
| AD-64737.1 | A-129399.2 | ACUCGUGGUGGACUUCTCUCA | 549 | A-129398.2 | UGAGAGAAGTCCACCACGAGUCU | 984 | 250_272 |

TABLE 3-continued

Unmodified Sense and Antisense Strand Sequences of HBV dsRNAs

| Duplex Name | Sense Oligo Name | Sense Sequence (5' to 3') | SEQ ID NO: | Antisense Oligo Name | Antisense Sequence (5' to 3') | SEQ ID NO: | Position in NC_003977.1 |
|---|---|---|---|---|---|---|---|
| AD-64738.1 | A-129382.3 | ACUCGUGGTGGACUUCTCUCA | 550 | A-129389.4 | UGAGAGAAGUCCACCACGAGUCU | 985 | 250_272 |
| AD-64739.1 | A-129378.1 | ACUCGUGGUGGACUUCGCUCA | 551 | A-127906.25 | UGAGAGAAGUCCACCACGAGUCU | 986 | 250_272 |
| AD-64740.1 | A-127905.19 | ACUCGUGGUGGACUUCUCUCA | 552 | A-129386.1 | UGAGAGAAGTCCACCACGAGUCU | 987 | 250_272 |
| AD-64741.1 | A-127905.27 | ACUCGUGGUGGACUUCUCUCA | 553 | A-129394.1 | UGAGAGAAGUCCACCACGAGUCU | 988 | 250_272 |
| AD-64742.1 | A-129373.2 | ACUCGUGGUGGACUUCUCUCA | 554 | A-129385.4 | UGAGAGAAGTCCACCACGAGUCU | 989 | 250_272 |
| AD-64743.1 | A-129384.3 | ACUCGUGGTGGACUUCACUCA | 555 | A-129389.5 | UGAGAGAAGUCCACCACGAGUCU | 990 | 250_272 |

TABLE 4

Modified Sense and Antisense Strand Sequences of HBV dsRNAs

| Duplex Name Name | Sense Oligo Name | Sense Sequence (5' to 3') | SEQ ID NO: | Antisense Oligo Name | Antisense Sequence (5' to 3') | SEQ ID NO: |
|---|---|---|---|---|---|---|
| AD-61522.2 | A-123463.2 | AfsgsUfuAfuAfuGfGfAfuGfEAfuGfgUfgGfuAfL96 | 991 | A-123464.2 | usAfsccCfacCfaUfcAfuccAfuAfuAfaCfiusgsa | 1210 |
| AD-61547.2 | A-123487.2 | GfsgsAtuGfuGfutcCfuFfGfcGfcGfuFfuUfuAfL96 | 992 | A-123488.2 | usAfsaAfaCfgCfcGfcagAfcAfcAfuCfcsasg | 1211 |
| AD-63938.2 | A-127896.1 | Y44ACUCGUGGUGGACUUCUCUCA | 993 | A-127897.1 | UGAGAGAGUCCACCACGAGUCU | 1212 |
| AD-63939.2 | A-127909.1 | ascsucGfuGfgUfgGfGfaCfuucCfucuccaL96 | 994 | A-127906.3 | usGfsaGfaGfaAfgUfccaCfcAfcGfaGfuscsu | 1213 |
| AD-63940.2 | A-127917.1 | acscsucguggugDacuuc(Tgn)cucaL96 | 995 | A-127906.11 | usGfsaGfaGfaAfgUfccaCfcAfcGfaGfuscsu | 1214 |
| AD-63940.3 | A-127917.4 | acscsucguggudGacuuc(Tgn)cucaL96 | 996 | A-127906.19 | usGfsaGfaGfaAfgUfccaCfcAfcGfaGfuscsu | 1215 |
| AD-63941.2 | A-127905.8 | AfscsUfcGfuGfgUfGfGfaCfuUfcUfcUfcAfL96 | 997 | A-127925.1 | usGfsaGfaGfaAfguccaCfcAfcGfgaGfuscsu | 1216 |
| AD-63942.2 | A-127933.1 | uscsGfuGfgUfgUfGfGfaCfuUfcUfcUfcAfL96 | 998 | A-127934.1 | usGfsaGfaGfaAfgUfccaCfcAfcGfasgsu | 1217 |
| AD-63943.2 | A-127944.2 | acscsucGfuGfguGfGfGfaCfuucucucaL96 | 999 | A-127942.2 | usGfsAfgaGfaAfgUfccaCfcAfcGfaguscsu | 1218 |
| AD-63945.2 | A-127910.1 | acscsucguGfgfgUfGfGfaCfuucucucaL96 | 1000 | A-127906.4 | usGfsaGfaGfaAfgUfccaCfcAfcGfaGfuscsu | 1219 |
| AD-63946.2 | A-127918.1 | acscsucguGfgfgUfGfGfacuuCfucucaL96 | 1001 | A-127906.12 | usGfsaGfaGfaAfgUfccaCfcAfcGfaGfuscsu | 1220 |
| AD-63947.2 | A-127905.9 | AfscsUfcGfuGfgUfGfGfaCfuUfcUfcUfcAfL96 | 1002 | A-127926.1 | usGfsaGfaGfaAfgUfccaCfcAfcsgsa | 1221 |
| AD-63948.2 | A-127935.1 | gsusGfgUfgUfGfGfaCfuUfcUfcUfcAfL96 | 1003 | A-127936.1 | usGfsaGfaGfaAfgUfccaCfcAfcsgsa | 1222 |
| AD-63949.2 | A-127944.3 | acscsucGfuGfguGfGfGfaCfuucucucaL96 | 1004 | A-127906.14 | usGfsaGfaGfaAfgUfccaCfcAfcGfaGfuscsu | 1223 |
| AD-63950.2 | A-127900.1 | Y44UfcGfuGfgUfgUfGfGfaCfuUfcUfcUfcAfusuY44 | 1005 | A-127901.1 | usGfsasGfaGfaAfgUfccaCfcAfcCfcAfcGfausu | 1224 |
| AD-63951.2 | A-127911.1 | acscsucguGfgfgUfGfGfacuuCfucucaL96 | 1006 | A-127906.5 | usGfsaGfaGfaAfgUfccaCfcAfcGfaGfuscsu | 1225 |
| AD-63952.2 | A-127905.2 | AfscsUfcGfuGfgUfGfGfaCfuUfcUfcUfcAfL96 | 1007 | A-127919.1 | usGfsaGfaagUfccaCfcAfcGfaGfuscsu | 1226 |
| AD-63953.2 | A-127905.10 | AfscsUfcGfuGfgUfGfGfaCfuUfcUfcUfcAfL96 | 1008 | A-127927.1 | usGfsagaAfgUfccaCfcAfcgaguscsu | 1227 |
| AD-63955.2 | A-127945.1 | acscsucguggdGfGfacuuucucaL96 | 1009 | A-127940.3 | usGfsAfgAfgAfgGfuccaCfCfacfgAfgsustu | 1228 |
| AD-63956.2 | A-127902.1 | Y44uscsGfuGfgUfgUfGfGfaCfuUfcUfcUfcAfY44 | 1010 | A-127903.1 | usGfsaGfaGfaAfgUfccaCfcAfcCfaAfcGfasusu | 1229 |
| AD-63957.2 | A-127912.1 | acscsucguGfgfgUfGfGfacuucucucaL96 | 1011 | A-127906.6 | usGfsaGfaGfaAfgUfccaCfcAfcGfaGfuscsu | 1230 |
| AD-63958.2 | A-127905.3 | AfscsUfcGfuGfgUfGfGfaCfuUfcUfcUfcAfL96 | 1012 | A-127920.1 | usGfsagaGfaAfgUfccaCfcAfcgaGfuscsu | 1231 |
| AD-63959.2 | A-127905.11 | AfscsUfcGfuGfgUfGfGfaCfuUfcUfcUfcAfL96 | 1013 | A-127928.1 | usGfsaGfagaAfguccaCfcAfcgaguscsu | 1232 |

TABLE 4-continued

Modified Sense and Antisense Strand Sequences of HBV dsRNAs

| Duplex Name Name | Sense Oligo Name | Sense Sequence (5' to 3') | SEQ ID NO: | Antisense Oligo Name | Antisense Sequence (5' to 3') | SEQ ID NO: |
|---|---|---|---|---|---|---|
| AD-63960.2 | A-126619.2 | usasUfuCfCfuAfgGfgUfacCfaAfL96 | 1014 | A-127938.1 | PusGfsaGfaGfaAfgUfccaCfcAfcsgsa | 1233 |
| AD-63961.2 | A-127945.2 | ascsucsgguGfGfacuucucucaL96 | 1015 | A-127942.3 | usGfsAfgaGfaAfgUfccaCfcAfcGfaguscsu | 1234 |
| AD-63962.2 | A-127902.2 | Y44uscsGfuGfgUfgGfacCfuCfucUfcuCfafY44 | 1016 | A-127904.1 | PusGfsaGfaGfaAfgUfccaCfcAfcGfasusu | 1235 |
| AD-63963.2 | A-127913.1 | ascsucsgguGfGfacuucucucaL96 | 1017 | A-127906.7 | usGfsaGfaGfaAfgUfccaCfcAfcGfaGfuscsu | 1236 |
| AD-63964.2 | A-127905.4 | AfscsUfcGfuGfgUfGfGfacCfuuCfcuCfucCfucAfL96 | 1018 | A-127921.1 | usGfsaGfaGfaAfgUfccaCfcAfcGfagusscu | 1237 |
| AD-63965.2 | A-127905.12 | AfscsUfcGfuGfgUfGfGfacCfuuCfcuCfucUfcAfL96 | 1019 | A-127929.1 | usGfsagaGfaaGfuccaCfcAfcgaguscsu | 1238 |
| AD-63966.2 | A-127939.1 | ascsUfcGfuggUfGfGfacuucucucaL96 | 1020 | A-127940.1 | usGfsAfgAfgAfaGfuccaCfcCfacfgAfguscsu | 1239 |
| AD-63967.2 | A-127945.3 | ascsugsgguGfGfacuucucucaL96 | 1021 | A-127906.15 | usGfsaGfaGfaAfgUfccaCfcAfcGfaGfuscsu | 1240 |
| AD-63968.2 | A-127905.1 | AfscsUfcGfuGfgUfGfGfacCfuuCfcuCfucUfcuCfAfL96 | 1022 | A-127906.1 | usGfsaGfaGfaAfgUfccaCfcAfcGfaGfuscsu | 1241 |
| AD-63968.4 | A-127905.15 | AfscsUfcGfuGfgUfGfGfacCfuuCfcuCfucUfcuCfAfL96 | 1023 | A-127906.1 | usGfsaGfaGfaAfgUfccaCfcAfcGfaGfuscsu | 1242 |
| AD-63968.5 | A-127905.17 | AfscsUfcGfuGfgUfGfGfacCfuuCfcuCfucUfcuCfAfL96 | 1024 | A-127906.17 | usGfsaGfaGfaAfgUfccaCfcAfcGfaGfuscsu | 1243 |
| AD-63969.2 | A-127914.1 | ascsucsguggUfGfacucucucaL96 | 1025 | A-127906.18 | usGfsaGfaGfaAfgUfccaCfcAfcGfaGfuscsu | 1244 |
| AD-63970.2 | A-127905.5 | AfscsUfcGfuGfgUfGfGfacCfuuCfcuCfucUfcuCfAfL96 | 1026 | A-127906.8 | usGfsaGfaGfaAfgUfccaCfcAfcGfaGfuscsu | 1245 |
| AD-63971.2 | A-127905.13 | AfscsUfcGfuGfgUfGfGfacCfuuCfcuCfucUfcuCfAfL96 | 1027 | A-127922.1 | usGfsagaGfaaUfccaCfcAfcgaGfuscsu | 1246 |
| AD-63972.2 | A-127941.1 | ascsUfcGfuGfgUfGfGfacCfuuCfucaL96 | 1028 | A-127930.1 | usGfsagaGfaaguccaCfcAfcAfgusscu | 1247 |
| AD-63973.2 | A-127946.1 | ascsucsgguGfdGacuucucucaL96 | 1029 | A-127942.1 | usGfsAfgaGfaGfaAfgdTccadCcAfcGfagusscu | 1248 |
| AD-63975.2 | A-127915.1 | ascsucsguggGfUfgGfacuuc(Tgn)cucaL96 | 1030 | A-127947.1 | usdGsaGfaGfaAfgUfccaCfcAfcGfagusscu | 1249 |
| AD-63976.2 | A-127905.6 | AfscsUfcGfuGfgUfGfGfacCfuuCfcuCfucUfcuCfAfL96 | 1031 | A-127923.1 | usGfsagaGfaAfgUfccaCfcAfcGfaGfuscsu | 1250 |
| AD-63977.2 | A-127917.2 | ascsucsgugdGacuuc(Tgn)cucaL96 | 1032 | A-127931.1 | usdGsagagaaguccadCcacgaguscsu | 1251 |
| AD-63978.2 | A-127943.1 | ascsUfcGfuGfgGfacCfuCfuUfcCfuCfufcaL96 | 1033 | A-127906.13 | usGfsaGfaGfaAfgUfccaCfcAfcGfaGfuscsu | 1252 |
| AD-63979.2 | A-127908.1 | ascsucGfuGfGfgUfgGfacCfuuCfcucAfL96 | 1034 | A-127906.2 | usGfsaGfaGfaAfgUfccaCfcAfcGfaGfuscsu | 1253 |
| AD-63980.2 | A-127916.1 | ascsucsguggGfacuuc(Tgn)cucaL96 | 1035 | A-127906.10 | usGfsaGfaGfaAfgUfccaCfcAfcGfaGfuscsu | 1254 |
| AD-63981.2 | A-127905.7 | AfscsUfcGfuGfgUfGfGfacCfuuCfcuCfucUfcuCfAfL96 | 1036 | A-127924.1 | usGfsagaGfaAfgUfccaCfcAfcGfagagfuscsu | 1255 |
| | | | 1037 | | | 1256 |

TABLE 4-continued

Modified Sense and Antisense Strand Sequences of HBV dsRNAs

| Duplex Name | Sense Oligo Name | Sense Sequence (5' to 3') | SEQ ID NO: | Antisense Oligo Name | Antisense Sequence (5' to 3') | SEQ ID NO: |
|---|---|---|---|---|---|---|
| AD-63982.2 | A-127917.3 | ascsucguggugGacuuc(Tgn)cucaL96 | 1038 | A-127932.1 | PusdGsagagaaguccadCcacgaguscsu | 1257 |
| AD-63983.2 | A-127944.1 | ascsucGfguGfgacfuucucucuL96 | 1039 | A-127940.2 | usGfsAfgAfgAfaGfuccaCfCfaCfgAfguscsu | 1258 |
| AD-63985.2 | A-127961.1 | gsusgggugGfacCfUfUfcucCfaauuuL96 | 1040 | A-127956.4 | asAfsaUfuGfaGfaGfaagUfcCfacCfcAfcsgsa | 1259 |
| AD-63986.2 | A-127969.1 | gsusgggugGfacCfUfUfcucuCfaauuuL96 | 1041 | A-127956.12 | asAfsaUfuGfaGfaGfaagUfcCfacCfcAfcsgsa | 1260 |
| AD-63987.2 | A-127955.9 | GfsusGfgUfgGfaCfUfUfcUfcUfcAfaUfuUfL96 | 1042 | A-127977.1 | asAfsaUfugaGfaGfaagUfccfaccAfcsgsa | 1261 |
| AD-63988.2 | A-127986.1 | usgsGfaCfUfUfcUfcUfcUfcAfaUfuUfL96 | 1043 | A-127987.1 | asAfsaUfuGfaGfaGfaagUfcCfascsc | 1262 |
| AD-63989.2 | A-127996.1 | gsusggguggacUfUfcucucaauuuL96 | 1044 | A-127992.2 | asAfsAfUfuGfaGfaGfaGfuccCfaCfcacsgsa | 1263 |
| AD-63990.2 | A-127950.1 | Y44GfgUfgGfaCfuUfcUfcAfaUfuUfusuY44 | 1045 | A-127951.1 | asAfsasUfuGfaGfaGfaAfgUfcCfaCfcsusu | 1264 |
| AD-63991.2 | A-127962.1 | gsusgggugGfacCfUfUfcUfcucaauuuL96 | 1046 | A-127956.5 | asAfsaUfuGfaGfaGfaagUfcCfacCfcAfcsgsa | 1265 |
| AD-63992.2 | A-127955.2 | GfsusGfgUfgGfaCfUfUfcUfcUfcAfaUfuUfL96 | 1047 | A-127956.1 | asAfsaUfuGfaGfaGfaagUfcCfacCfcAfcsgsa | 1266 |
| AD-63993.2 | A-127955.10 | GfsusGfgUfgGfaCfUfUfcUfcUfcAfaUfuUfL96 | 1048 | A-127978.1 | asAfsauugaGfaGfaagUfcCfaccacsgsa | 1267 |
| AD-63994.2 | A-127984.2 | gsgUfgGfaCfUfUfcUfcUfcUfcAfaUfuUfL96 | 1049 | A-127988.1 | PasAfsaUfuGfaGfaUfcCfcCfcsasc | 1268 |
| AD-63995.2 | A-127996.2 | gsusggguggacUfUfcucucaauuuL96 | 1050 | A-127993.2 | asAfsAfUfuGfaGfaGfuuGfaGfuCfCfaCfcacsgsa | 1269 |
| AD-63996.2 | A-127952.1 | Y44gsgsgUfgGfaCfuUfcUfcUfcAfaUfuUfY44 | 1051 | A-127953.1 | asAfsaUfuGfaGfaGfaGfAfgUfcCfaCfcsusu | 1270 |
| AD-63997.2 | A-127963.1 | gsusgggugGfacCfuUfcucucaauuuL96 | 1052 | A-127956.6 | asAfsaUfuGfaGfaGfaagUfcCfacCfcAfcsgsa | 1271 |
| AD-63999.2 | A-127955.11 | GfsusGfgUfgGfaCfUfUfcUfcUfcAfaUfuUfL96 | 1053 | A-127979.1 | asAfsaUfugaGfagaagUfcCfaccacsgsa | 1272 |
| AD-64000.2 | A-127986.2 | usgsGfaCfUfUfcUfcUfcUfcAfaUfuUfL96 | 1054 | A-127989.1 | PasAfsaUfuGfaGfaGfaagUfcCfascsc | 1273 |
| AD-64001.2 | A-127996.3 | gsusggguggacUfUfcucucaauuuL96 | 1055 | A-127994.2 | asAfsAfUfuGfaGfaGfaagUfcCfaCfcacsgsa | 1274 |
| AD-64002.2 | A-127952.2 | Y44gsgsgUfgGfaCfuUfcUfcUfcAfaUfuUfY44 | 1056 | A-127954.1 | PasAfsaUfuGfaGfaGfaAfgUfcCfaCfcsusu | 1275 |
| AD-64003.2 | A-127956.7 | gsusgggugGfacCfuUfcucucaauuuL96 | 1057 | A-127956.7 | asAfsaUfuGfaGfaGfaagUfcCfacCfcAfcsgsa | 1276 |
| AD-64004.2 | A-127955.4 | GfsusGfgUfgGfaCfUfUfcUfcUfcAfaUfuUfL96 | 1058 | A-127972.1 | asAfsAfsaUfuGfaGfaGfaccaccsgsa | 1277 |
| AD-64005.2 | A-127955.12 | GfsusGfgUfgGfaCfUfUfcUfcUfcAfaUfuUfL96 | 1059 | A-127980.1 | asAfsauuuGfagAfgaagUfccfaccacsgsa | 1278 |
| AD-64006.2 | A-127990.1 | gsusgGfugGfacCfUfUfcUfcAfaUfuuL96 | 1060 | A-127991.1 | asAfsAfUfugaGfaGfaagUfcCfaCfcacsgsa | 1279 |
| AD-64007.2 | A-127996.4 | gsusggguggacUfUfcucucaauuuL96 | 1061 | A-127995.2 | asAfsAfUfuGfaGfaGfaagUfcCfcaCfcacsgsa | 1280 |

TABLE 4-continued

Modified Sense and Antisense Strand Sequences of HBV dsRNAs

| Duplex Name Name | Sense Oligo Name | Sense Sequence (5' to 3') | SEQ ID NO: | Antisense Oligo Name | Antisense Sequence (5' to 3') | SEQ ID NO: |
|---|---|---|---|---|---|---|
| AD-64008.2 | A-127955.1 | GfsusGfgUfgGfaCfUfUfcUfcUfcAfaUfaAfuUfL96 | 1062 | A-127956.1 | asAfsaUfsaUfuGfaGfaGfaagUfcCfacCfcAfcsgsa | 1281 |
| AD-64008.4 | A-127955.1 | GfsusGfgUfgGfaCfUfUfcUfcUfcAfaUfaAfuUfL96 | 1063 | A-127956.1 | asAfsaUfsaUfuGfaGfaGfaagUfcCfaCfcAfcAfcsgsa | 1282 |
| AD-64008.4 | A-127955.15 | GfsusGfgUfgGfaCfUfUfcUfcUfcAfaUfaAfuUfL96 | 1064 | A-127956.14 | asAfsaUfsaUfuGfaGfaGfaGfaagUfcCfaCfcAfcsgsa | 1283 |
| AD-64009.2 | A-127965.1 | gsusgguggacuUfcucucaauuuL96 | 1065 | A-127956.8 | asAfsaUfsaUfuGfaGfaGfaagUfcCfaCfcAfcsgsa | 1284 |
| AD-64010.2 | A-127955.5 | GfsusGfgUfgGfaCfUfUfcUfcUfcAfaUfaAfuUfL96 | 1066 | A-127973.1 | asAfsauuUfsgaGfaagUfcCfaccAfcsgsa | 1285 |
| AD-64011.2 | A-127955.13 | GfsusGfgUfgGfaCfUfUfcUfcUfcAfaUfaAfuUfL96 | 1067 | A-127981.1 | asAfsauuUfsagagaagUfcCfaccacgsa | 1286 |
| AD-64012.2 | A-127990.2 | gsusGfgUfgGfaCfUfUfcUfcUfcAfaUfaAfuuL96 | 1068 | A-127992.1 | asAfsAfUfuGfaGfaGfaagUfcCfaCfcacsgsa | 1287 |
| AD-64013.2 | A-127997.1 | gsusgguggacuTdTcucucaauuuL96 | 1069 | A-127998.1 | asdAsAfuugaGfaGfaagUfcCfaCfcacsgsa | 1288 |
| AD-64014.2 | A-127957.1 | Y44GfsusGfgUfgGfaCfUfUfcUfcUfcAfaUfaAfuUfL96 | 1070 | A-127958.1 | PasAfsaUfuGfaGfaGfaagUfcCfaCfcAfcsgsa | 1289 |
| AD-64015.2 | A-127966.1 | gsusgguggacuUfcucucu(Agn)auuuL96 | 1071 | A-127956.9 | asAfsaUfuGfaGfaGfaagUfcCfaCfcAfcsgsa | 1290 |
| AD-64016.2 | A-127955.6 | GfsusGfgUfgGfaCfUfUfcUfcUfcAfaUfaAfuUfL96 | 1072 | A-127974.1 | asAfsauuUfaGfaGfaagUfcCfaccacsgsa | 1291 |
| AD-64017.2 | A-127968.2 | gsusgguggacudTcucuc(Agn)auuuL96 | 1073 | A-127982.1 | asdAsauugagagaagdTcccaccacsgsa | 1292 |
| AD-64018.2 | A-127990.3 | gsusgguggacudTcucuc(Agn)auuuL96 | 1074 | A-127993.1 | asAfsAfuuGfaGfaGfaagUfcCfcaCfcacsgsa | 1293 |
| AD-64019.2 | A-127959.1 | gsusgUfgGfaCfUfUfcUfcUfcAfauuUfL96 | 1075 | A-127956.2 | asAfsaUfuGfaGfaGfaagUfcCfaCfcAfcsgsa | 1294 |
| AD-64020.2 | A-127967.1 | gsusgguggacuUfcucuc(Agn)auuuL96 | 1076 | A-127956.10 | asAfsaUfuGfaGfaGfaagUfcCfaCfcAfcsgsa | 1295 |
| AD-64021.2 | A-127955.7 | GfsusGfgUfgGfaCfUfUfcUfcUfcAfaUfaAfuUfL96 | 1077 | A-127975.1 | asAfsaUfugaGfaGfaGfaagUfcCfaccAfcsgsa | 1296 |
| AD-64022.2 | A-127968.3 | gsusgguggacudTcucuc(Agn)auuuL96 | 1078 | A-127983.1 | PasdAsauugagagagdTcccaccacsgsa | 1297 |
| AD-64023.2 | A-127990.4 | gsusGfgUfgGfaCfUfUfcUfcUfcAfaUfaAfuuL96 | 1079 | A-127994.1 | asAfsAfUfuGfaGfaGfaGfaagUfCfcaCfcacsgsa | 1298 |
| AD-64024.2 | A-127960.1 | gsusggUfgGfaCfUfUfcUfcUfcAfauuUfL96 | 1080 | A-127956.3 | asAfsaUfuGfaGfaGfaagUfcCfaCfcAfcsgsa | 1299 |
| AD-64025.2 | A-127968.1 | gsusgguggacudTcucuc(Agn)auuuL96 | 1081 | A-127956.11 | asAfsaUfuGfaGfaGfaagUfcCfaCfcAfcsgsa | 1300 |
| AD-64026.2 | A-127955.8 | GfsusGfgUfgGfaCfUfUfcUfcUfcAfaUfaAfuUfL96 | 1082 | A-127976.1 | asAfsaUfugaGfaagaagUfcCfaccAfcsgsa | 1301 |
| AD-64027.2 | A-127984.1 | gsgUfgGfaCfUfUfcUfcUfcAfaUfaAfuUfL96 | 1083 | A-127985.1 | asAfsAfUfugaGfaGfaGfaagUfcCfactcsasc | 1302 |
| AD-64028.2 | A-127990.5 | gsusGfgUfgGfaCfUfUfcUfcUfcAfaUfaAfuuL96 | 1084 | A-127995.1 | asAfsAfUfugaUfuGfaGfaGfaagUfCfcaCfcacsgsa | 1303 |
| AD-64272.2 | A-128001.2 | GfsusGfcAfcUfucCfGfCfUfuCfafcCfucCfuGfL96 | 1085 | A-128002.2 | csAfsgAfgGfuGfaAfgcgAfaGfuGfcAfcsasc | 1304 |

TABLE 4-continued

Modified Sense and Antisense Strand Sequences of HBV dsRNAs

| Duplex Name Name | Sense Oligo Name | Sense Sequence (5' to 3') | SEQ ID NO: | Antisense Oligo Name | Antisense Sequence (5' to 3') | SEQ ID NO: |
|---|---|---|---|---|---|---|
| AD-64274.1 | A-128363.1 | GfsusUfgAfcAfaAfAfAfucCfcUfcAfcAfauUfL96 | 1086 | A-128364.1 | asUfsuGfuGfaGfgAfuuuUfuGfuCfaAfcsasa | 1305 |
| AD-64275.1 | A-128377.1 | UfsgsUfgAfcCfaAfaAfAfaUfcCfuCfacCfaAfL96 | 1087 | A-128378.1 | usUfsgGfgAfgGfaUfuuuUfgUfcCfaCfcsasg | 1306 |
| AD-64276.1 | A-128393.1 | GfsgsUfgGfacCfuUfCfUfcUfcAfaUfuUfuAfL96 | 1088 | A-128394.1 | usAfsaAfaUfuGfaGfagaAfgUfcCfaCfcsasc | 1307 |
| AD-64277.1 | A-128407.1 | UfscsUfuUfuGfgAfGfUfgUfgGfaUfuGfucCfgAfL96 | 1089 | A-128408.1 | usCfsgAfaUfcCfacCfacuCfcAfaAfaGfascsa | 1308 |
| AD-64278.1 | A-128407.1 | UfscsUfuUfuGfgAfGfUfgUfgGfaUfuGfucCfgAfL96 | 1090 | A-128408.1 | usCfsgAfaUfcCfacCfacuCfcAfaAfaGfascsa | 1309 |
| AD-64279.1 | A-128423.1 | AfscsUfgUfucCfaAfgCfcUfcCfaAfgCfuAfL96 | 1091 | A-128424.1 | usAfsgCfcUfuGfgAfgCfguUfgAfacCfaAfgsasc | 1310 |
| AD-64280.1 | A-128435.1 | UfscsUfgCfcGfaUfcCfaUfcCfatCfgGfcGfgAfL96 | 1092 | A-128436.1 | usCfscGfcAfgUfaUfggaUfcGfgCfaGfasgsg | 1311 |
| AD-64281.1 | A-128379.1 | AfsusUfgUfucCfuGfcGfcGfuUfuAfuAfL96 | 1093 | A-128380.1 | usAfsuAfaAfcGfcGfcAfgAfcAfcAfuscsc | 1312 |
| AD-64282.1 | A-128395.1 | CfscsCfcCfuGfucCfuGfcCfuCfUfcAfuAfL96 | 1094 | A-128396.1 | usAfsuGfaGfaAfgGfcacAfgAfcAfgGfGfgsasg | 1313 |
| AD-64283.1 | A-128409.1 | GfscsCfuAfaUfcAfuCfAfcUfcfuCfuUfgGfuCfucCfaUfL96 | 1095 | A-128410.1 | asUfsgAfaCfaCfaAfgAfgauGfaUfuAfgCfgsasg | 1314 |
| AD-64284.1 | A-128425.1 | UfscsUfaGfacCfutCfGfUfgUfgGfuGfAfcUfucCfL96 | 1096 | A-128426.1 | gsAfsaGfuCfcAfcCfacGfAfgUfcUfaGfascsu | 1315 |
| AD-64285.1 | A-128437.1 | CfsusGfcCfgAfuCffcAfuAfcUfgCfgGfaAfL96 | 1097 | A-128438.1 | usUfscCfgCfagUfaUfuggAftuCfgGfcAfgsasg | 1316 |
| AD-64286.1 | A-128365.1 | UfsusUfuUfcUfuGfcUfuGfAfcAfaAfAfuAfL96 | 1098 | A-128366.1 | usAfsuUfuUfuGfuCfaacAfaGfaFfaAfascsc | 1317 |
| AD-64289.1 | A-128381.1 | AfscsCfuUfcCfuUfcAfuCffcCffuCfuCfuAfL96 | 1099 | A-128382.1 | usAfsgAfaGfaAfcCfaacAfaGfaAfaFfgAfusgsa | 1318 |
| AD-64290.1 | A-128367.1 | GfsusUfuUfcGfuCfuGfuGfAfcAfaCfAfaAfaUfL96 | 1100 | A-128368.1 | asUfsuUfuUfgUfcAfacaAfgAfaAfaCfscsc | 1319 |
| AD-64291.1 | A-128383.1 | CfsusGfcCfuAfaUfcUfcUfuGfuUfgUfAfL96 | 1101 | A-128384.1 | usAfsaCfaAfgAfAfugaUfuAfgGfcAfgsasg | 1320 |
| AD-64292.1 | A-128399.1 | UfscsCfuCfacCfaAfuCfAfcCfaGfuCffuCfuAfL96 | 1102 | A-128400.1 | usAfscUfcCfuGfuGfauuUfgGfuAfgGfasusu | 1321 |
| AD-64293.1 | A-128413.1 | CfsusUfgUfgAfcCfAfAfaAfuCfcUfcAfL96 | 1103 | A-128414.1 | usUfsgAfgGfaUfUfuugUfcAfaCfaAfgsasa | 1322 |
| AD-64294.1 | A-128439.1 | GfscsAfaCfuUfuuUffCfaCfcCfoUfcCfuUfL96 | 1104 | A-128440.1 | asGfsgCfaGfGfgUfgaaAfaAfaGfuFfuGfcsasu | 1323 |
| AD-64295.1 | A-128369.1 | GfsgsGfaAfcAfgAfGfAfGfUfuCfaCfagCffaAfutUfL96 | 1105 | A-128370.1 | usAfsuGfcUfgUfaGfcucUfgUfuUfcCfcsasa | 1324 |
| AD-64297.1 | A-128385.1 | CfsgsUfgGfugGfaAfCfuUfcUfufCfaAfuUfL96 | 1106 | A-128386.1 | asAfsuUfgAfaFfaguCfcAfcCfaGfcsasg | 1325 |
| AD-64298.1 | A-128415.1 | CfsusGfcUfaAfuFfcCfcUfuUfCfuUfaUfL96 | 1107 | A-128416.1 | usAfsaGfaAfaUfgGfcauAfgCfagCfAfgsasa | 1326 |
| AD-64299.1 | A-128427.1 | GfsusUfgGfaUfgUfgGfufCfgfCffcAfaFfL96 | 1108 | A-128428.1 | asAfscCfgCfCfgFfaGfacaCfaUfcCfaAfcsgsa | 1327 |
| AD-64299.1 | A-128441.1 | UfsusCfaUfcCfuGfcCfuFfgCfcCfuAfL96 | 1109 | A-128442.1 | usAfsgGfcAfuAfgCfagcAfgGfuFfgAfasgsa | 1328 |

TABLE 4-continued

Modified Sense and Antisense Strand Sequences of HBV dsRNAs

| Duplex Name Name | Sense Oligo Name | Sense Sequence (5' to 3') | SEQ ID NO: | Antisense Oligo Name | Antisense Sequence (5' to 3') | SEQ ID NO: |
|---|---|---|---|---|---|---|
| AD-64300.1 | A-128371.1 | UfsusCfuUfgUfuGfAfCfaaAfaAfUfcCfuAfL96 | 1110 | A-128372.1 | usAfsgGfaUfuUfuUfgucAfaCfaAfgAfasasa | 1329 |
| AD-64302.1 | A-128417.1 | UfsasUfaUfgGfaUfgGfuGfgUfgUfaUfuAfL96 | 1111 | A-128418.1 | usAfsaCfcAfcAfucaUfcCfaUfaUfasasc | 1330 |
| AD-64303.1 | A-128429.1 | UfsusGfaUfcCfuGfCfUfgCfuAfuGfcCfuCfL96 | 1112 | A-128430.1 | gsAfsgGfcAfuAfgCfagcAfgGfaUfgAfasgsa | 1331 |
| AD-64304.1 | A-128443.1 | GfsusGfcAfcUfuCfgUfcUfuUfcAfcCfuCfuAfL96 | 1113 | A-128444.1 | usAfsgAfgUfgGfaAfgcgAfaGfuGfcAfcsasc | 1332 |
| AD-64305.1 | A-128373.1 | UfsusGfaCfaAfaAfAfUfcCfucCfacfAfuAfuAfL96 | 1114 | A-128374.1 | usAfsuUfgAfgGfauuUfuUfgUfcAfascsa | 1333 |
| AD-64307.1 | A-128403.1 | AfsasGfcCfuCfaAfAfgFcUfgUfgCfcUfuAfL96 | 1115 | A-128404.1 | usAfsaGfgCfaCfaGfcuuGfgAfgGfcUfusgsa | 1334 |
| AD-64308.1 | A-128419.1 | CfcsSUfcUfuCfaAfUfcCfcUfgGfcCfuAfuAfL96 | 1116 | A-128420.1 | usAfsuAfgCfaGfcAfggaUfgAfaGfaGfsasa | 1335 |
| AD-64309.1 | A-128431.1 | CfcsSUfgCfuGfcUfAfUfgCfcUfcAfucfuUfL96 | 1117 | A-128432.1 | asAfsgAfuGfaGfgCfauaGfcAfgCfaGfgsasu | 1336 |
| AD-64310.1 | A-128375.1 | CfsasUfCfuCfuGfCfUfgUfGfcfCfuUfcAfuAfL96 | 1118 | A-128376.1 | asGfsaAfuGfaAfgCfcAfcacaAfgAfaGfuGfsasg | 1337 |
| AD-64311.1 | A-128391.1 | CfscsGfuCfuGftuGfCfCfuUfcAfCfAfuCfuAfL96 | 1119 | A-128392.1 | usAfsgAfuGfaAfggcAfcAfgAfcGfgsgsg | 1338 |
| AD-64312.1 | A-128405.1 | CfscsUfcAfuCfuUfcCfUfuGfuUfcUfuAfL96 | 1120 | A-128406.1 | asGfsaAfcCfaAfcAfagaAfgAfuGfaGfgscsa | 1339 |
| AD-64313.1 | A-128421.1 | CfscsAfcCfaAfaUfGfCfcCfuAfuCfcUfuAfL96 | 1121 | A-128422.1 | usAfsaGfaUfaGfgCfgcaUffuGfgGfuGfgsusc | 1340 |
| AD-64314.1 | A-128433.1 | GfscsUfcCfuCfuGfcAfaAfAfcfcUfcAfcAfuAfUfL96 | 1122 | A-128434.1 | asGfsuAfuGfaUfcGftggcAfgAfgGfaGfcscsa | 1341 |
| AD-64315.1 | A-128363.2 | GfsusUfgAfcAfaAfAfAfcfcUfcAfUfcAfaAfUfL96 | 1123 | A-128445.1 | PasUfsuGfuGfaGfgGfAfuuuUfguCfaAfcscsa | 1342 |
| AD-64316.1 | A-128377.2 | UfsgsUfuGfaCfaAfaAfaUfcCfuCfaAfuAfL96 | 1124 | A-128453.1 | PusUfsgAfsAfaUfuGfaGfagaAfgUfccCfaCfcasasg | 1343 |
| AD-64317.1 | A-128393.2 | GfsgsUfgfaCftuUfCfuUfcAfuUfuUfuAfL96 | 1125 | A-128461.1 | PusAfsfAfuGfaAfccfacuCfcAfacAfaGfascsa | 1344 |
| AD-64318.1 | A-128407.2 | UfscsUfuUfugAfgGfAfGfuGfcCfuAfuCfgAfL96 | 1126 | A-128469.1 | PusCfsgAfaUfcCfacucfcAfaAfaGfascsa | 1345 |
| AD-64319.1 | A-128423.2 | UfscsUfuUfuUfgfGfCfaAfgCfcGfaAfuCfgAfL96 | 1127 | A-128477.1 | PusCfsgAfsgCfuUfgGfagCfcuUfgAfaCfaAfgsasc | 1346 |
| AD-64320.1 | A-128435.2 | AfscsUfgfuCfcGfaUfcCfaUfaCfuGfcGfgAfL96 | 1128 | A-128483.1 | PusCfsGfcAfgUfaUfggaUfcGfgfaCfaGfasgsg | 1347 |
| AD-64321.1 | A-128463.3 | AfsgsUfuAfuGfgAfUfgGfaUfgUfgGfuAfL96 | 1129 | A-128446.1 | PusAfsfgCfaUfccAfuccAfuAfuAfaCfuscsc | 1348 |
| AD-64322.1 | A-128379.2 | AfsusGfuGftuCfuGfUfuUfaUfaAfuAfL96 | 1130 | A-128454.1 | PusAfsuAfaAfaCfgCfcgcAfgAfcAfcAfuscsc | 1349 |
| AD-64323.1 | A-128395.2 | CfscsSCfcGfuCftuGfUfCfuUfcAfuAfL96 | 1131 | A-128462.1 | PusAfsuGfaGfaAfgAfcacAfgAfcGfgGfsasg | 1350 |
| AD-64324.1 | A-128409.2 | GfscsSCfuAfuCfAfUfcCfuCfuUfcAfaUfL96 | 1132 | A-128470.1 | PasUfsgAfcAfaAfgAfgAfgauGfaUfaAfgCfgsasg | 1352 |

TABLE 4-continued

Modified Sense and Antisense Strand Sequences of HBV dsRNAs

| Duplex Name Name | Sense Oligo Name | Sense Sequence (5' to 3') | SEQ ID NO: | Antisense Oligo Name | Antisense Sequence (5' to 3') | SEQ ID NO: |
|---|---|---|---|---|---|---|
| AD-64325.1 | A-128425.2 | UfscsUfaGfaCfuCfGfUfgGfuGfgAfcUfuCfL96 | 1134 | A-128478.1 | PgsAfsaGfuCfcAfcCfacgAfgUfcUfaGfascsu | 1353 |
| AD-64326.1 | A-128437.2 | CfsusGfccCfgAfuCfCfAfuAfcUfgCfgGfaAfL96 | 1135 | A-128484.1 | PusUfscCfgcCfaGfuAfuggAfuCfggGfcAfgsasg | 1354 |
| AD-64328.1 | A-128381.2 | AfsusCfuUfcUfugGfUfUfgGfuUfcUfucUfuAfL96 | 1136 | A-128455.1 | PusAfsgAfaGfaAfcCfaacAfaGfaAfgAfusgsa | 1355 |
| AD-64330.1 | A-128411.2 | UfsusCfuCfuCfaAfUfUfuUfcUfaGfgGfgAfL96 | 1137 | A-128471.1 | PusCfscCfcUfaGfaAfaauUfgAfgAfgAfasgsu | 1356 |
| AD-64331.1 | A-127905.16 | AfscsUfcGfuGfuGfGfaCfuUfcUfcUfcUfcAfL96 | 1138 | A-127907.2 | PusGfsaGfaGfaAfgUfccaCfcAfcGfaGfuscsu | 1357 |
| AD-64332.1 | A-128001.3 | GfsusGfcAfcUfcGfcUfuUfcAfcCfucUfuGfL96 | 1139 | A-128485.1 | PcsAfsgAfgGfuGfaAfgcgAfaGfuGfcAfcsasc | 1358 |
| AD-64333.1 | A-128367.2 | GfsusUfuUfcUfuGfUfuGfaCfaAfaAfaAfaUfL96 | 1140 | A-128448.1 | PasUfsuUfuUfgUfcAfacaAfgAfaAfaAfcscsc | 1359 |
| AD-64334.1 | A-128383.2 | CfsusGfccCfuaAfuCfcAfucCfucUfuGfgUfuAfL96 | 1141 | A-128456.1 | PusAfsaCfaAfgAfcAfugaUfuAfgGfcAfgsasg | 1360 |
| AD-64335.1 | A-128399.2 | UfscsCfuCfaCftaAfuAfcCfcCfaCfaGfaGfuAfL96 | 1142 | A-128464.1 | PusAfscUfcUfgUfgGfuAfuugGfuGfaGfasusu | 1361 |
| AD-64336.1 | A-128413.2 | CfsusUfgUfuGfaCfaAfaAfaAfaUfcUfcUfaUfL96 | 1143 | A-128472.1 | PusUfsgAfgGfaUfuUfuugUfcAfacCfaAfgsasa | 1362 |
| AD-64337.1 | A-127955.16 | GfsusGfgUfgUfgCfaCfuUfuUfcCfaCfcUfcUfL96 | 1144 | A-127958.2 | PasAfsaUfuGfaGfaGfaagUfcCftaCfcAfcsgsa | 1363 |
| AD-64338.1 | A-128439.2 | GfsusGfcAfaCfuUfuUfcCfaCfcUfcUfgCfcUfL96 | 1145 | A-128486.1 | PasGfsgCfaGfaGfgUfgaaAfaAfgUfuGfcAfsasu | 1364 |
| AD-64339.1 | A-128369.2 | GfsgsGfaAfcAfaCfaAfGfcUfaCfaGfcAftuAfL96 | 1146 | A-128449.1 | PusAfsuGfcUfgUfaGfcucUfuGftuUfcCfcsasa | 1365 |
| AD-64341.1 | A-128401.2 | UfscsAfuCfuUfcGfuAfuUfgCfcCfuCfaCfcUfL96 | 1147 | A-128465.1 | PusAfsgGfaAfcCfaAfcaaGfaAfugUfGfasgsg | 1366 |
| AD-64342.1 | A-128415.2 | CfsusGftaUfgCfcCftuUfcUfgCfcCfuUfuAfL96 | 1148 | A-128473.1 | PusAfsaGfaUfgAfgGfcauAfgCfaGfcAfgsgsa | 1367 |
| AD-64343.1 | A-128427.2 | GfsusUfgGfaUfgUfgGfUfcCfgGfcGfuUfL96 | 1149 | A-128479.1 | PasAfscGfcCfgGfaCfacaCfaUfcCfaAfcsgsa | 1368 |
| AD-64344.1 | A-128441.2 | UfsusCfaUfccCftuGftuUfgAfCfCfaAfafAfuCfCfuAfL96 | 1150 | A-128487.1 | PusAfsgGfcAfuAfgCfagcAfgGftaUfgAfasgsa | 1369 |
| AD-64345.1 | A-128371.2 | UfsusCfuUfgUfuGfAfCfaAfaAfauUfcCfuAfL96 | 1151 | A-128450.1 | PusAfsgGfaUfuUfuUfgucAfaCfaAfgAfasasa | 1370 |
| AD-64347.1 | A-123487.3 | GfsgsAfuGfugGfuCfcGfgCfgUfuUfiUfaAfL96 | 1152 | A-128466.1 | PusAfsaAfaCfgCfcGfgaAfcAfcAfucCfsasg | 1371 |
| AD-64348.1 | A-128417.2 | UfsasUfaGfaUfgCfcCftaAfgaUfaUftAfL96 | 1153 | A-128474.1 | PusAfsaUfaCfcAfcAfucaUfcCfcAfucUfasasc | 1372 |
| AD-64349.1 | A-128429.2 | UfsusCfaUfccCftuGfCfuAfcUfuCfcCfuCfL96 | 1154 | A-128480.1 | PgsAfsgGfgAfaGfuAfgcAfgGfaUfgAfasgsa | 1373 |
| AD-64350.1 | A-128443.2 | GfsusGfcAfcUfuGfcCfuAfcAfcCfuCfuAfL96 | 1155 | A-128488.1 | PusAfsgGfaGfgUfgAfgGfcAfcAfcAfcsasc | 1374 |
| AD-64351.1 | A-128373.2 | UfsusGfaCfaAfaAfaAfuUfcCfuCfaCfaAfuAfL96 | 1156 | A-128451.1 | PusAfsuUfgUfgAfgGfauuUfuUfigCfaAfcsa | 1375 |
| AD-64352.1 | A-128339.2 | CfscsAfaGfuGfuUfgFcAfcAfaAfL96 | 1157 | A-128459.1 | PusUfsuGfcGfuCfaGfcaaAfcAfcUfuGfscsa | 1376 |

TABLE 4-continued

Modified Sense and Antisense Strand Sequences of HBV dsRNAs

| Duplex Name Name | Sense Oligo Name | Sense Sequence (5' to 3') | SEQ ID NO: | Antisense Oligo Name | Antisense Sequence (5' to 3') | SEQ ID NO: |
|---|---|---|---|---|---|---|
| AD-64352.1 | A-128389.2 | CfscsAfaGfuGfuUfGfcUfaGfAfcGfcAfaAfL96 | 1158 | A-128459.1 | PusUfsuGfcGfuCfaGfcaaAfcAfcUfuGfgscsa | 1377 |
| AD-64353.1 | A-128403.2 | AfsasGfccCfuCfcAfAfGfcUfgUfGfcCfuUfAfL96 | 1159 | A-128467.1 | PusAfsaGfgCfaCfaGfcuuGfgAfgGfcUfusgsa | 1378 |
| AD-64354.1 | A-128419.2 | CfscsUfcUfuCfaUfCfCfuGfcCfuAfuAfuAfL96 | 1160 | A-128475.1 | PusAfsuAfgCfaGfcAfggaUfgAfaGfaGfgsasa | 1379 |
| AD-64355.1 | A-128431.2 | CfscsUfgCfuGfcUfAfUfgCfcUfcAfucCfuUfL96 | 1161 | A-128481.1 | PasAfsgAfuGfaGfgCftauaGfcAfgCfaGfgsasu | 1380 |
| AD-64356.1 | A-128375.2 | CfsasUfcUfuCfuGfCfCfuUfcUfcAfucCfuAfL96 | 1162 | A-128452.1 | PasAfsaAfgGfaCfacaAfgAfaGfaUfgsasg | 1381 |
| AD-64357.1 | A-128391.2 | CfscsGfucCfuGfcCfCfuUfcUfcAfucCfuAfL96 | 1163 | A-128460.1 | PusAfsgAfuGfaGfaAfggcAfcAfgAfcGfgsgsg | 1382 |
| AD-64358.1 | A-128405.2 | CfscsAfucCfaAfaUfcUfCfUfuGfGfuUfcUfL96 | 1164 | A-128468.1 | PasGfsaAfcCfaAfcAfagaAfgAfuGfaGfgscsa | 1383 |
| AD-64359.1 | A-128421.2 | CfscsAfccCfaAfAfuUfGfcCfcCfuAfUfcUfuAfL96 | 1165 | A-128476.1 | PusAfsaUfaGfgGfgcaUfuUfgCfuGfgsusc | 1384 |
| AD-64360.1 | A-128433.2 | GfscsUfccCfuCfcGfcCfgAfuCfCfAfuAfcUfL96 | 1166 | A-128482.1 | PasGfsuAfuGfgAfuCfggcAfgAfgGfaGfcscsa | 1385 |
| AD-64700.1 | A-129379.1 | ascsucguggugdTacuu(Cgn)ucucaL96 | 1167 | A-127906.26 | usGfsaGfaGfaAfgUfccaCfcAfcGfaGfuscsu | 1386 |
| AD-64701.1 | A-127905.20 | AfscsUfcGfuCfgUfGfGfuGfGfuGfuGfAfcuucdAcucaL96 | 1168 | A-129387.1 | PusgsagagadGaagucaCcacgagusCsu | 1387 |
| AD-64702.1 | A-127905.28 | AfscsUfcGfuCfgUfGfGfuGfGfuGfuGfAfcuucdAcucaL96 | 1169 | A-129395.1 | usGsagadGaaguccaCcacgagusCsu | 1388 |
| AD-64703.1 | A-129376.2 | ascsucguggudGacuucdAcucaL96 | 1170 | A-129385.5 | usdGsagadGaaguccadCcacgaguscsu | 1389 |
| AD-64704.1 | A-129380.1 | ascsucguggdTgdTacuucdAcucaL96 | 1171 | A-129389.6 | usdGsagadGaagaguccadCcacgaguscsu | 1390 |
| AD-64705.1 | A-127905.21 | AfscsUfcGfuCfgUfGfGfuGfGfuGfuGfAfcuucdAcucaL96 | 1172 | A-127906.27 | usGfsaGfaGfaAfgUfccaCfcAfcGfaGfuscsu | 1391 |
| AD-64706.1 | A-127905.29 | AfscsUfcGfuCfgUfGfGfuGfGfuGfuGfAfcuucdAcucaL96 | 1173 | A-129388.1 | usdGsaGfaGfaGfaAfgUfccaCfcAfcGfaGfuscsu | 1392 |
| AD-64707.1 | A-129382.2 | ascsucgugggdTgdGacuuc(Tgn)cucaL96 | 1174 | A-129396.1 | usgsagagadGaaguccadCcacgaguscsu | 1393 |
| AD-64708.1 | A-129373.4 | ascsucguggudGacuu(Cgn)ucucaL96 | 1175 | A-129385.6 | usdGsagagadGaagaguccadCcacgaguscsu | 1394 |
| AD-64709.1 | A-129373.1 | ascsucguggudGacuu(Cgn)ucucaL96 | 1176 | A-129391.2 | usdGsagagadGaagaguccadCcacgaguscsu | 1395 |
| AD-64710.1 | A-129381.1 | ascsucguggdTgdTacuucdAcucaL96 | 1177 | A-127906.20 | usGfsaGfaGfaAfgUfccaCfcAfcGfaGfuscsu | 1396 |
| AD-64711.1 | A-127905.22 | AfscsUfcGfuCfgUfGfGfuGfGfuGfuGfAfcUfcAfL96 | 1178 | A-127906.28 | usGfsaGfaGfaAfgUfccaCfcAfcGfaGfuscsu | 1397 |
| AD-64712.1 | A-129382.2 | ascsucgugggdTgdGacuu(Cgn)ucucaL96 | 1179 | A-129389.1 | usdGsagadGaaguccadCcacgaguscsu | 1398 |
| AD-64713.1 | A-127905.30 | AfscsUfcGfuCfgUfGfGfuGfGfuGfuGfAfcUfcAfL96 | 1180 | A-129397.1 | PusgsagagadGaagaguccadCcacgaguscsu | 1399 |
| AD-64714.1 | A-129384.2 | ascsucguggdTgdGacuucdAcucaL96 | 1181 | A-129385.7 | usdGsagagaagdTccadCcacgaguscsu | 1400 |

TABLE 4-continued

Modified Sense and Antisense Strand Sequences of HBV dsRNAs

| Duplex Name Name | Sense Oligo Name | Sense Sequence (5' to 3') | SEQ ID NO: | Antisense Oligo Name | Antisense Sequence (5' to 3') | SEQ ID NO: |
|---|---|---|---|---|---|---|
| AD-64715.1 | A-129376.4 | ascsucguggugGacuucdAcucaL96 | 1182 | A-129391.3 | usdGsagadGaagdTccadCcacgaguscsu | 1401 |
| AD-64716.1 | A-129374.1 | ascsucguggugGacuucu(Cgn)ucaL96 | 1183 | A-127906.21 | usGfsaGfaGfaAfgUfccaCfcAfcGfaGfuscsu | 1402 |
| AD-64717.1 | A-129382.1 | ascsucguggdTgdGacuuc(Tgn)cucaL96 | 1184 | A-127906.29 | usGfsaGfaAfgUfccaCfcAfcGfaGfuscsu | 1403 |
| AD-64718.1 | A-127905.23 | AfscsUfcGfuGfgUfGfGfaCfuUfcUfcUfcAfL96 | 1185 | A-129390.1 | usdGsagagadAguccadCcacgaguscsu | 1404 |
| AD-64719.1 | A-127917.5 | ascsucguggugGacuuc(Tgn)cucaL96 | 1186 | A-129385.2 | usdGsagagaagdTccadCcacgaguscsu | 1405 |
| AD-64720.1 | A-129381.2 | ascsucguggdTgdTacuucdAcucaL96 | 1187 | A-129385.8 | usdGsagagaagdTccadCcacgaguscsu | 1406 |
| AD-64721.1 | A-129382.4 | ascsucguggdTgdGacuuc(Tgn)cucaL96 | 1188 | A-129391.4 | usdGsagadGaagdTccadCcacgaguscsu | 1407 |
| AD-64722.1 | A-129375.1 | ascsucguggugGacuucY34cucaL96 | 1189 | A-127906.22 | usGfsaGfaGfaAfgUfccaCfcAfcGfaGfuscsu | 1408 |
| AD-64723.1 | A-129383.1 | ascsucguggugGdAcuuc(Tgn)cucaL96 | 1190 | A-127906.30 | usGfsaGfaGfaAfgUfccaCfcAfcGfaGfuscsu | 1409 |
| AD-64725.1 | A-127917.6 | ascsucguggugGacuuc(Tgn)cucaL96 | 1191 | A-129398.1 | PusdGsagagaagdTccadCcacgaguscsu | 1410 |
| AD-64726.1 | A-129373.3 | ascsucguggugGacuuu(Cgn)ucucaL96 | 1192 | A-129389.2 | usdGsagadGaaguccadCcacgaguscsu | 1411 |
| AD-64727.1 | A-129384.4 | ascsucguggdTgdGacuucdAcucaL96 | 1193 | A-129391.5 | usdGsagadGaagdTccadCcacgaguscsu | 1412 |
| AD-64728.1 | A-129376.1 | ascsucguggugGacuucdAcucaL96 | 1194 | A-127906.23 | usGfsaGfaGfaAfgUfccaCfcAfcGfaGfuscsu | 1413 |
| AD-64729.1 | A-129384.1 | ascsucguggdTgdGacuucdAcucaL96 | 1195 | A-127906.31 | usGfsaGfaGfaAfgUfccaCfcAfcGfaGfuscsu | 1414 |
| AD-64730.1 | A-127905.25 | AfscsUfcGfuGfgUfGfGfaCfuUfcUfcUfcAfL96 | 1196 | A-129392.1 | usGsagagaagdTccadCcacgaguscsu | 1415 |
| AD-64731.1 | A-129399.1 | Y34ascsucguggugGacuuc(Tgn)cucaL96 | 1197 | A-129385.3 | usdGsagagaagdTccadCcacgaguscsu | 1416 |
| AD-64732.1 | A-129376.3 | ascsucguggugGacuucdAcucaL96 | 1198 | A-129389.3 | usdGsagadGaaguccadCcacgaguscsu | 1417 |

TABLE 4-continued

Modified Sense and Antisense Strand Sequences of HBV dsRNAs

| Duplex Name Name | Sense Oligo Name | Sense Sequence (5' to 3') | SEQ ID NO: | Antisense Oligo Name | Antisense Sequence (5' to 3') | SEQ ID NO: |
|---|---|---|---|---|---|---|
| AD-64733.1 | A-129381.4 | ascsucguggdTgdTacuucdAcucaL96 | 1199 | A-129391.6 | usdGsagadGaagdTccadCcacgaguscsu | 1418 |
| AD-64734.1 | A-129377.1 | ascsucguggdGacuucdCcucaL96 | 1200 | A-127906.24 | usGfsaGfaGfaAfgUfccaCfcAfcGfaGfuscsu | 1419 |
| AD-64735.1 | A-127905.18 | AfscsUfcGfuGfuGfgUfGfGfaCfuUfcUfcUfcAfL96 | 1201 | A-129385.1 | usdGsagagaagdTccadCcacgaguscsu | 1420 |
| AD-64736.1 | A-127905.26 | AfscsUfcGfuGfuGfgUfGfGfaCfuUfcUfcUfcAfL96 | 1202 | A-129393.1 | usdGsagagaagdTccaCcacgaguscsu | 1421 |
| AD-64737.1 | A-129399.2 | Y34ascsucguggdGacuuc(Tgn)cucaL96 | 1203 | A-129398.2 | PusdGsagagaagdTccadCcacgaguscsu | 1422 |
| AD-64738.1 | A-129382.3 | ascsucguggdTgdGacuuc(Tgn)cucaL96 | 1204 | A-129389.4 | usdGsagadGaaguccadCcacgaguscsu | 1423 |
| AD-64739.1 | A-129378.1 | ascsucguggugdGacuucdGcucaL96 | 1205 | A-127906.25 | usGfsaGfaGfaAfgUfccaCfcAfcGfaGfuscsu | 1424 |
| AD-64740.1 | A-127905.19 | AfscsUfcGfuGfuGfgUfGfGfaCfuUfcUfcUfcUfcAfL96 | 1206 | A-129386.1 | usgsagagaagdTccadCcacgaguscsu | 1425 |
| AD-64741.1 | A-127905.27 | AfscsUfcGfuGfuGfgUfGfGfaCfuUfcUfcUfcUfcAfL96 | 1207 | A-129394.1 | usSsagagaagdTccaCcacgaguscsu | 1426 |
| AD-64742.1 | A-129373.2 | ascsucguggugdGacuu(Cgn)ucucaL96 | 1208 | A-129385.4 | usdGsagagaagdTccadCcacgaguscsu | 1427 |
| AD-64743.1 | A-129384.3 | ascsucguggdTgdGacuucdAcucaL96 | 1209 | A-129389.5 | usdGsagadGaaguccadCcacgaguscsu | 1428 |

TABLE 5

HBV single dose screen using Dual-Glo Luciferase ® Assay

| Duplex ID | 10 nM Avg | 0.1 nM Avg | 10 nM SD | 0.1 nM_SD |
|---|---|---|---|---|
| AD-63938.2 | 0.12 | ND | 0.01 | ND |
| AD-63950.2 | 0.38 | ND | 0.04 | ND |
| AD-63956.2 | 0.31 | ND | 0.02 | ND |
| AD-63962.2 | 0.16 | ND | 0.03 | ND |
| AD-63968.2 | 0.56 | ND | 0.10 | ND |
| AD-63968.2 | 0.79 | ND | 0.09 | ND |
| AD-63979.2 | 0.54 | ND | 0.02 | ND |
| AD-63939.2 | 0.51 | ND | 0.01 | ND |
| AD-63945.2 | 0.54 | ND | 0.08 | ND |
| AD-63951.2 | 0.60 | ND | 0.03 | ND |
| AD-63957.2 | 0.57 | ND | 0.02 | ND |
| AD-63963.2 | 0.91 | ND | 0.06 | ND |
| AD-63969.2 | 0.92 | ND | 0.02 | ND |
| AD-63975.2 | 0.83 | ND | 0.01 | ND |
| AD-63980.2 | 0.77 | ND | 0.01 | ND |
| AD-63940.2 | 0.77 | ND | 0.06 | ND |
| AD-63946.2 | 0.60 | ND | 0.10 | ND |
| AD-63952.2 | 0.48 | ND | 0.04 | ND |
| AD-63958.2 | 0.51 | ND | 0.01 | ND |
| AD-63964.2 | 0.58 | ND | 0.04 | ND |
| AD-63970.2 | 0.69 | ND | 0.07 | ND |
| AD-63976.2 | 0.63 | ND | 0.04 | ND |
| AD-63981.2 | 0.60 | ND | 0.04 | ND |
| AD-63941.2 | 0.56 | ND | 0.09 | ND |
| AD-63947.2 | 0.55 | ND | 0.08 | ND |
| AD-63953.2 | 0.56 | ND | 0.06 | ND |
| AD-63959.2 | 0.51 | ND | 0.03 | ND |
| AD-63965.2 | 0.55 | ND | 0.03 | ND |
| AD-63971.2 | 0.65 | ND | 0.02 | ND |
| AD-63977.2 | 0.88 | ND | 0.01 | ND |
| AD-63982.2 | 0.73 | ND | 0.07 | ND |
| AD-63942.2 | 0.32 | ND | 0.09 | ND |
| AD-63948.2 | 0.57 | ND | 0.09 | ND |
| AD-63960.2 | 0.92 | ND | 0.05 | ND |
| AD-63966.2 | 0.85 | ND | 0.06 | ND |
| AD-63972.2 | 0.82 | ND | 0.06 | ND |
| AD-63978.2 | 0.83 | ND | 0.02 | ND |
| AD-63983.2 | 0.89 | ND | 0.02 | ND |
| AD-63943.2 | 0.86 | ND | 0.04 | ND |
| AD-63949.2 | 0.76 | ND | 0.02 | ND |
| AD-63955.2 | 0.82 | ND | 0.02 | ND |
| AD-63961.2 | 0.83 | ND | 0.07 | ND |
| AD-63967.2 | 0.86 | ND | 0.03 | ND |
| AD-63973.2 | 0.86 | ND | 0.03 | ND |
| AD-63990.2 | 0.27 | ND | 0.07 | ND |
| AD-63996.2 | 0.29 | ND | 0.06 | ND |
| AD-64002.2 | 0.30 | ND | 0.11 | ND |
| AD-64008.2 | 0.28 | ND | 0.05 | ND |
| AD-64008.2 | 0.34 | ND | 0.07 | ND |
| AD-64014.2 | 0.30 | ND | 0.03 | ND |
| AD-64019.2 | 0.36 | ND | 0.04 | ND |
| AD-64024.2 | 0.27 | ND | 0.03 | ND |
| AD-63985.2 | 0.28 | ND | 0.06 | ND |
| AD-63991.2 | 0.33 | ND | 0.02 | ND |
| AD-63997.2 | 0.47 | ND | 0.07 | ND |
| AD-64003.2 | 0.69 | ND | 0.06 | ND |
| AD-64009.2 | 0.91 | ND | 0.03 | ND |
| AD-64015.2 | 0.69 | ND | 0.09 | ND |
| AD-64020.2 | 0.81 | ND | 0.06 | ND |
| AD-64025.2 | 0.77 | ND | 0.06 | ND |
| AD-63986.2 | 0.28 | ND | 0.05 | ND |
| AD-63992.2 | 0.44 | ND | 0.04 | ND |
| AD-64004.2 | 0.45 | ND | 0.04 | ND |
| AD-64010.2 | 0.37 | ND | 0.05 | ND |
| AD-64016.2 | 0.48 | ND | 0.05 | ND |
| AD-64021.2 | 0.39 | ND | 0.03 | ND |
| AD-64026.2 | 0.30 | ND | 0.02 | ND |
| AD-63987.2 | 0.20 | ND | 0.02 | ND |
| AD-63993.2 | 0.33 | ND | 0.02 | ND |
| AD-63999.2 | 0.36 | ND | 0.05 | ND |
| AD-64005.2 | 0.45 | ND | 0.11 | ND |
| AD-64011.2 | 0.39 | ND | 0.08 | ND |
| AD-64017.2 | 0.84 | ND | 0.06 | ND |
| AD-64022.2 | 0.81 | ND | 0.03 | ND |
| AD-64027.2 | 0.38 | ND | 0.05 | ND |
| AD-63988.2 | 0.37 | ND | 0.04 | ND |
| AD-63994.2 | 0.23 | ND | 0.01 | ND |
| AD-64000.2 | 0.29 | ND | 0.00 | ND |
| AD-64006.2 | 0.40 | ND | 0.04 | ND |
| AD-64012.2 | 0.45 | ND | 0.17 | ND |
| AD-64018.2 | 0.65 | ND | 0.07 | ND |
| AD-64023.2 | 0.53 | ND | 0.07 | ND |
| AD-64028.2 | 0.52 | ND | 0.07 | ND |
| AD-63989.2 | 0.47 | ND | 0.04 | ND |
| AD-63995.2 | 0.81 | ND | 0.03 | ND |
| AD-64001.2 | 0.83 | ND | 0.04 | ND |
| AD-64007.2 | 0.87 | ND | 0.04 | ND |
| AD-64013.2 | 0.88 | ND | 0.03 | ND |
| AD-64289.1 | 0.276 | ND | 0.009 | ND |
| AD-64333.1 | 0.208 | ND | 0.015 | ND |
| AD-64285.1 | 0.324 | ND | 0.034 | ND |
| AD-64300.1 | 0.225 | ND | 0.005 | ND |
| AD-64345.1 | 0.102 | ND | 0.090 | ND |
| AD-64292.1 | 0.288 | ND | 0.232 | ND |
| AD-64336.1 | 0.199 | ND | 0.056 | ND |
| AD-64275.1 | 0.287 | ND | 0.185 | ND |
| AD-64316.1 | 0.297 | ND | 0.024 | ND |
| AD-64274.1 | 0.209 | ND | 0.033 | ND |
| AD-64315.1 | 0.199 | ND | 0.002 | ND |
| AD-64305.1 | 0.360 | ND | 0.035 | ND |
| AD-64351.1 | 0.281 | ND | 0.014 | ND |
| AD-64291.1 | 0.725 | ND | 0.005 | ND |
| AD-64335.1 | 0.478 | ND | 0.020 | ND |
| AD-64283.1 | 0.917 | ND | 0.018 | ND |
| AD-64304.1 | 0.937 | ND | 0.050 | ND |
| AD-64325.1 | 0.446 | ND | 0.223 | ND |
| AD-64350.1 | 0.934 | ND | 0.055 | ND |
| AD-63968.4 | 0.748 | ND | 0.008 | ND |
| AD-64331.1 | 0.294 | ND | 0.038 | ND |
| AD-64008.4 | 0.416 | ND | 0.028 | ND |
| AD-64337.1 | 0.318 | ND | 0.049 | ND |
| AD-64295.1 | 0.415 | ND | 0.034 | ND |
| AD-64276.1 | 0.453 | ND | 0.073 | ND |
| AD-64317.1 | 0.203 | ND | 0.040 | ND |
| AD-64330.1 | 0.313 | ND | 0.030 | ND |
| AD-64298.1 | 0.797 | ND | 0.007 | ND |
| AD-64343.1 | 0.667 | ND | 0.020 | ND |
| AD-61547.2 | 0.637 | ND | 0.019 | ND |
| AD-64347.1 | 0.418 | ND | 0.066 | ND |
| AD-64280.1 | 0.754 | ND | 0.092 | ND |
| AD-64322.1 | 0.407 | ND | 0.013 | ND |
| AD-64308.1 | 0.720 | ND | 0.055 | ND |
| AD-64354.1 | 0.315 | ND | 0.034 | ND |
| AD-64303.1 | 0.815 | ND | 0.150 | ND |
| AD-64349.1 | 0.447 | ND | 0.030 | ND |
| AD-64299.1 | 0.831 | ND | 0.007 | ND |
| AD-64344.1 | 0.404 | ND | 0.009 | ND |
| AD-64309.1 | 0.856 | ND | 0.005 | ND |
| AD-64355.1 | 0.498 | ND | 0.040 | ND |
| AD-64297.1 | 0.895 | ND | 0.024 | ND |
| AD-64342.1 | 0.508 | ND | 0.006 | ND |
| AD-64312.1 | 0.590 | ND | 0.034 | ND |
| AD-64358.1 | 0.425 | ND | 0.044 | ND |
| AD-64341.1 | 0.223 | ND | 0.119 | ND |
| AD-64310.1 | 0.301 | ND | 0.064 | ND |
| AD-64356.1 | 0.336 | ND | 0.024 | ND |
| AD-64286.1 | 0.611 | ND | 0.012 | ND |
| AD-64328.1 | 0.317 | ND | 0.043 | ND |
| AD-61522.1 | 0.447 | ND | 0.008 | ND |
| AD-64321.1 | 0.237 | ND | 0.009 | ND |
| AD-64302.1 | 0.523 | ND | 0.020 | ND |
| AD-64348.1 | 0.208 | ND | 0.003 | ND |
| AD-64352.1 | 0.343 | ND | 0.224 | ND |
| AD-64352.1 | 0.567 | ND | 0.015 | ND |
| AD-64314.1 | 0.920 | ND | 0.044 | ND |
| AD-64360.1 | 0.778 | ND | 0.029 | ND |
| AD-64279.1 | 0.882 | ND | 0.034 | ND |
| AD-64320.1 | 0.589 | ND | 0.017 | ND |
| AD-64284.1 | 0.696 | ND | 0.119 | ND |
| AD-64326.1 | 0.552 | ND | 0.009 | ND |
| AD-64281.1 | 0.921 | ND | 0.019 | ND |
| AD-64323.1 | 0.715 | ND | 0.097 | ND |

TABLE 5-continued

HBV single dose screen using Dual-Glo Luciferase ® Assay

| Duplex ID | 10 nM Avg | 0.1 nM Avg | 10 nM SD | 0.1 nM_SD |
|---|---|---|---|---|
| AD-64311.1 | 0.815 | ND | 0.030 | ND |
| AD-64357.1 | 0.549 | ND | 0.001 | ND |
| AD-64272.2 | 0.965 | ND | 0.024 | ND |
| AD-64332.1 | 0.548 | ND | 0.013 | ND |
| AD-64293.1 | 0.837 | ND | 0.013 | ND |
| AD-64338.1 | 0.597 | ND | 0.031 | ND |
| AD-64290.1 | 0.489 | ND | 0.026 | ND |
| AD-64334.1 | 0.368 | ND | 0.003 | ND |
| AD-64282.1 | 0.767 | ND | 0.009 | ND |
| AD-64324.1 | 0.726 | ND | 0.077 | ND |
| AD-64278.1 | 0.951 | ND | 0.077 | ND |
| AD-64319.1 | 0.895 | ND | 0.029 | ND |
| AD-64307.1 | 0.890 | ND | 0.065 | ND |
| AD-64353.1 | 0.567 | ND | 0.500 | ND |
| AD-64277.1 | 0.416 | ND | 0.019 | ND |
| AD-64277.1 | 0.839 | ND | 0.058 | ND |
| AD-64318.1 | 0.613 | ND | 0.042 | ND |
| AD-64318.1 | 0.768 | ND | 0.042 | ND |
| AD-64313.1 | 0.698 | ND | 0.062 | ND |
| AD-64359.1 | 0.441 | ND | 0.081 | ND |
| AD-64294.1 | 0.563 | ND | 0.066 | ND |
| AD-64339.1 | 0.486 | ND | 0.044 | ND |
| AD-63968.5 | 0.57 | 0.72 | 0.07 | 0.03 |
| AD-63940.3 | 0.81 | 0.83 | 0.11 | 0.03 |
| AD-64710.1 | 0.79 | 0.85 | 0.12 | 0.04 |
| AD-64716.1 | 0.73 | 0.85 | 0.08 | 0.01 |
| AD-64722.1 | 0.67 | 0.80 | 0.06 | 0.02 |
| AD-64728.1 | 0.74 | 0.87 | 0.06 | 0.05 |
| AD-64734.1 | 0.78 | 0.83 | 0.08 | 0.05 |
| AD-64739.1 | 0.73 | 0.85 | 0.07 | 0.02 |
| AD-64700.1 | 0.54 | 0.75 | 0.13 | 0.02 |
| AD-64705.1 | 0.67 | 0.79 | 0.15 | 0.04 |
| AD-64711.1 | 0.57 | 0.83 | 0.13 | 0.04 |
| AD-64717.1 | 0.72 | 0.83 | 0.13 | 0.02 |
| AD-64723.1 | 0.83 | 0.87 | 0.12 | 0.01 |
| AD-64729.1 | 0.74 | 0.87 | 0.08 | 0.07 |
| AD-64735.1 | 0.73 | 0.89 | 0.05 | 0.04 |
| AD-64740.1 | 0.89 | 0.88 | 0.05 | 0.07 |
| AD-64701.1 | 0.88 | 0.84 | 0.07 | 0.05 |
| AD-64706.1 | 0.71 | 0.88 | 0.12 | 0.05 |
| AD-64712.1 | 0.81 | 0.86 | 0.13 | 0.07 |
| AD-64718.1 | 0.84 | 0.89 | 0.16 | 0.01 |
| AD-64730.1 | 0.88 | 0.89 | 0.02 | 0.04 |
| AD-64736.1 | 0.80 | 0.88 | 0.10 | 0.05 |
| AD-64741.1 | 0.85 | 0.83 | 0.06 | 0.05 |
| AD-64702.1 | 0.87 | 0.93 | 0.02 | 0.06 |
| AD-64707.1 | 0.95 | 0.88 | 0.05 | 0.08 |
| AD-64713.1 | 0.90 | 0.85 | 0.08 | 0.03 |
| AD-64719.1 | 0.80 | 0.89 | 0.09 | 0.09 |
| AD-64725.1 | 0.70 | 0.84 | 0.09 | 0.03 |
| AD-64731.1 | 0.82 | 0.87 | 0.04 | 0.08 |
| AD-64737.1 | 0.76 | 0.84 | 0.09 | 0.08 |
| AD-64742.1 | 0.76 | 0.85 | 0.09 | 0.03 |
| AD-64703.1 | 0.79 | 0.88 | 0.05 | 0.02 |
| AD-64708.1 | 0.83 | 0.82 | 0.08 | 0.06 |
| AD-64714.1 | 0.75 | 0.85 | 0.12 | 0.03 |
| AD-64720.1 | 0.61 | 0.81 | 0.17 | 0.04 |
| AD-64726.1 | 0.75 | 0.83 | 0.07 | 0.02 |
| AD-64732.1 | 0.86 | 0.84 | 0.14 | 0.10 |
| AD-64738.1 | 0.80 | 0.90 | 0.04 | 0.02 |
| AD-64743.1 | 0.75 | 0.85 | 0.12 | 0.04 |
| AD-64704.1 | 0.67 | 0.78 | 0.16 | 0.02 |
| AD-64709.1 | 0.83 | 0.86 | 0.16 | 0.03 |
| AD-64715.1 | 0.87 | 0.88 | 0.09 | 0.04 |
| AD-64721.1 | 0.77 | 0.82 | 0.12 | 0.06 |
| AD-64727.1 | 0.75 | 0.85 | 0.14 | 0.02 |
| AD-64733.1 | 0.67 | 0.81 | 0.14 | 0.03 |

Example 3. Synthesis and In Vitro Screening of Additional iRNA Duplexes

Additional iRNA molecules targeting the HBV genome were synthesized as described above. A detailed list of the additional modified HBV sense and antisense strand sequences is shown in Table 6.

A single dose screen of these duplexes was performed by transfecting the duplexes into HepG2.215 and Hep3B cells and measuring Firefly (transfection control) and Rinella (fused to HBV target sequence) luciferase, as described above. The results of the assays in HepG2.2.15 cells are shown in Table 7 and the results of the assays in Hep3B cells are provided in Table 8.

TABLE 6

Modified Sense and Antisense Strand Sequences of HBV dsRNAs

| DuplexID | Sense Sequence (5' to 3') | SEQ ID NO: | Antisense Sequence (5' to 3') | SEQ ID NO: |
|---|---|---|---|---|
| AD-65369 | uscsguGfgUfGfGfacuuCfUfcucaL96 | 1429 | PusGfsagaGfaAfGfuccaCfcAfcgasusu | 1458 |
| AD-65381 | uscsguGfgUfGfGfacuucucucaL96 | 1430 | PusGfsagaGfaAfGfuccaCfcAfcgasusu | 1459 |
| AD-63962 | Y44uscsGfuGfgUfgGfaCfuUfcUfcUfcAfY44 | 1431 | PusGfsaGfaGfaAfgUfcCfaCfcAfcGfasusu | 1460 |
| AD-63938 | Y44ACUCGUGGUGGACUUCUCUCA | 1432 | UGAGAGAAGUCCACCACGAGUCU | 1461 |
| AD-65561 | uscsguGfgUfGfGfacuuCfUfcucaL96 | 1433 | UfsGfsagaGfaAfGfuccaCfcAfcgasusu | 1462 |
| AD-65566 | uscsguGfgUfGfGfacuucucucaL96 | 1434 | UfsGfsagaGfaAfGfuccaCfcAfcgasusu | 1463 |
| AD-63944 | Y44ucGuGGuGGAcuucucucAusuY44 | 1435 | UfGfagAfgAfAfGUfccaCfcAfcgAusu | 1464 |
| AD-63968 | AfscsUfcGfuGfgUfGfGfaCfuUfcUfcUfcAfL96 | 1436 | usGfsaGfaGfaAfgUfccaCfcAfcGfaGfuscsu | 1465 |
| AD-65406 | uscsguGfgUfGfGfacuuCfUfcucaL96 | 1437 | usGfsagaGfaAfGfuccaCfcAfcgasusu | 1466 |
| AD-65396 | ascsucguGfgUfGfGfacuucucucaL96 | 1438 | usGfsagaGfaagaccaCfcAfcgasusu | 1467 |
| AD-65427 | gsusgcacUfuCfGfCfuucaccucuaL96 | 1439 | PusAfsgagGfugaagcgAfaGfugcacsusu | 1468 |

TABLE 6-continued

Modified Sense and Antisense Strand Sequences of HBV dsRNAs

| DuplexID | Sense Sequence (5' to 3') | SEQ ID NO: | Antisense Sequence (5' to 3') | SEQ ID NO: |
|---|---|---|---|---|
| AD-65573 | gsusgcacUfuCfGfCfuucaCfCfucuaL96 | 1440 | UfsAfsgagGfuGfAfagcgAfaGfugcacsasc | 1469 |
| AD-65432 | gscsacUfucGfCfuucacCfucuaL96 | 1441 | PusAfsgagGfuGfAfagcgAfaGfugcsasc | 1470 |
| AD-64332 | GfsusGfcAfcUfuCfGfCfuUfcAfcCfuCfuGfL96 | 1442 | PcsAfsgAfgGfuGfaAfgcgAfaGfuGfcAfcsasc | 1471 |
| AD-64322 | AfsusGfuGfuCfuGfCfGfgCfgUfuUfuAfuAfL96 | 1443 | PusAfsuAfaAfaCfgCfcgcAfgAfcAfcAfuscsc | 1472 |
| AD-64272 | GfsusGfcAfcUfuCfGfCfuUfcAfcCfuCfuGfL96 | 1444 | csAfsgAfgGfuGfaAfgcgAfaGfuGfcAfcsasc | 1473 |
| AD-65583 | gscsacuucgdCuucac(Cgn)ucuaL96 | 1445 | usdAsgagDGugaagcgdAagugcsusu | 1474 |
| AD-63994 | gsgsUfgGfaCfUfUfcUfcUfcUfcAfaUfuUfL96 | 1446 | PasAfsaUfuGfaGfaGfaagUfcCfaCfcsasc | 1475 |
| AD-65370 | csgsugguGfgAfCfUfucucUfCfaauuL96 | 1447 | asAfsuugAfgAfGfaaguCfcAfccagcsasg | 1476 |
| AD-65265 | gsusggugGfaCfUfUfcUfcucaauuuL96 | 1448 | asAfsaUfugagaGfaagUfcCfaccAfcsgsa | 1477 |
| AD-65407 | csgsugguGfgAfCfUfucucUfCfaauuL96 | 1449 | asAfsuugAfgAfgAfaguCfcAfccagcsasg | 1478 |
| AD-64027 | gsgsUfgGfaCfUfUfcUfcUfcUfcAfaUfuUfL96 | 1450 | asAfsaUfuGfaGfaGfaagUfcCfaCfcsasc | 1479 |
| AD-65266 | gsusggugGfaCfUfUfUfcucuCfaauuuL96 | 1451 | asAfsaUfugagaGfaagUfcCfaccAfcsgsa | 1480 |
| AD-65389 | usgsgudGgucdTucucuaaauuL96 | 1452 | asdAsuugagagdAagudCcaccasusu | 1481 |
| AD-64008 | GfsusGfgUfgGfaCfUfUfcUfcUfcUfcAfaUfuUfL96 | 1453 | asAfsaUfuGfaGfaGfaagUfcCfaCfcAfcsgsa | 1482 |
| AD-65377 | csgsuggudGgucdTucucuaaauuL96 | 1454 | asdAsuugagagdAagudCcaccagcsusu | 1483 |
| AD-65409 | gsgsuggaCfuUfCfUfufcucaAfUfuuuaL96 | 1455 | PusAfsaaaUfuGfAfgagaAfgUfccaccsasc | 1484 |
| AD-65403 | gsgsuggaCfuUfCfUfufcucaAfUfuuuaL96 | 1456 | usAfsaaaUfuGfAfgagaAfgUfccaccsasc | 1485 |
| AD-65385 | usgsgacuacdTcucaaauuaL96 | 1457 | usdAsaaauugadGagadAguccasusu | 1486 |

TABLE 7

HBV single dose screen In HepG2.2.15 cells using Dual-Glo Luciferase ® Assay

| Duplex ID | PORF-1_A | PORF-1_B | SORF-2_A | SORF-2_B |
|---|---|---|---|---|
| AD-65369 | 0.1875 | 0.042 | 0.0446 | 0.3018 |
| AD-65381 | 0.086 | 0.249 | 0.1008 | 0.553 |
| AD-63962 | 0.4838 | 0.3475 | 0.2237 | 0.5258 |
| AD-63938 | 0.3587 | 2.1213 | 0.0501 | 1.1434 |
| AD-65561 | 0.1076 | 0.3801 | 0.0718 | 0.6897 |
| AD-65566 | 0.4127 | 0.3211 | 0.185 | 11.1161 |
| AD-63944 | 0.9489 | 0.7098 | 0.393 | 0.2771 |
| AD-63968 | NoIC50 | NoIC50 | 1.8788 | NoIC50 |
| AD-65406 | 3.3749 | 18.8396 | 3.8204 | 2.2662 |
| AD-65396 | NoIC50 | 6.8758 | 3.7382 | 4.2157 |
| AD-65427 | 0.0089 | 0.0181 | 0.0066 | 0.015 |
| AD-65573 | 0.0174 | 0.0332 | 0.0029 | 0.0227 |
| AD-65432 | 0.0211 | 0.0593 | 0.0112 | 0.0366 |
| AD-64332 | 0.0268 | 0.0329 | 0.0624 | 0.0217 |
| AD-64322 | 0.0963 | 0.1077 | 0.0992 | 0.0963 |
| AD-64272 | 0.0773 | 0.1199 | 0.0763 | 0.093 |
| AD-65583 | 0.1624 | 0.2228 | 0.1568 | 0.1496 |
| AD-63994 | 0.7019 | 0.1467 | 0.0832 | 0.0385 |
| AD-65370 | 0.2404 | 0.7916 | 0.3952 | 0.1964 |
| AD-65265 | 0.2255 | 0.5008 | 0.2893 | 0.318 |
| AD-65407 | 0.9533 | 0.261 | 0.4254 | 0.1121 |
| AD-64027 | 0.7692 | 0.5887 | 0.5208 | 0.5697 |
| AD-65266 | 3.4109 | 0.5055 | 0.8532 | 0.3658 |
| AD-65389 | 0.9172 | 0.6514 | 0.4915 | 0.2872 |
| AD-64008 | 1.2738 | 0.7865 | 1.9519 | 0.808 |
| AD-65377 | 0.6052 | 1.6 | 24.9403 | 0.6065 |
| AD-65409 | 1.8304 | 1.6479 | 0.104 | 0.0557 |
| AD-65403 | 12.1516 | 0.667 | 1.006 | 0.233 |

TABLE 7-continued

HBV single dose screen In HepG2.2.15 cells using Dual-Glo Luciferase ® Assay

| Duplex ID | PORF-1_A | PORF-1_B | SORF-2_A | SORF-2_B |
|---|---|---|---|---|
| AD-65385 | NoIC50 | NoIC50 | NoIC50 | NoIC50 |

TABLE 8

HBV single dose screen In Hep3B cells using Dual-Glo Luciferase ® Assay

| Duplex ID | PORF-1_A | PORF-1_B |
|---|---|---|
| AD-65369 | 0.0982 | 0.0508 |
| AD-65381 | 0.2392 | 0.1097 |
| AD-63962 | 0.0769 | 0.0706 |
| AD-63938 | 0.039 | 0.0111 |
| AD-65561 | 0.6316 | 0.6931 |
| AD-65566 | 0.2747 | 0.5331 |
| AD-63944 | 0.1317 | 0.0566 |
| AD-63968 | 0.4374 | 0.8811 |
| AD-65406 | 1.4961 | 1.2573 |
| AD-65396 | 1.9971 | 0.9952 |
| AD-65427 | 0.0234 | 0.006 |
| AD-65573 | 0.0346 | 0.0334 |
| AD-65432 | 0.0352 | 0.2664 |
| AD-64332 | 0.0221 | 0.4541 |
| AD-64322 | 0.1743 | 0.1616 |
| AD-64272 | 0.1885 | 0.6699 |
| AD-65583 | 0.1241 | 8.1611 |

TABLE 8-continued

HBV single dose screen In Hep3B cells using Dual-Glo Luciferase ® Assay

| Duplex ID | PORF-1_A | PORF-1_B |
|---|---|---|
| AD-63994 | 3.3623 | 5.2897 |
| AD-65370 | 0.2281 | NoIC50 |
| AD-65265 | NoIC50 | 7.3426 |
| AD-65407 | 0.1404 | 1.3833 |
| AD-64027 | 27.1417 | 1.1832 |
| AD-65266 | NoIC50 | NoIC50 |
| AD-65389 | NoIC50 | NoIC50 |
| AD-64008 | NoIC50 | NoIC50 |
| AD-65377 | NoIC50 | NoIC50 |
| AD-65409 | 1.8065 | 3.436 |
| AD-65403 | 0.5113 | 18.0359 |
| AD-65385 | NoIC50 | NoIC50 |

A subset of these duplexes were also assayed for in vitro stability using two assays, a tritosome stability assay and a cytosol stability assay.

For the tritosome stability assays, rat liver tritosomes (Xenotech custom product PR14044) were thawed to room temperature and diluted to 0.5 units/mL Acid Phosphatase in 20 mM Sodium Citrate pH 5.0 Buffer. Twenty-four hour samples were prepared by mixing 100 μL of 0.5 units/mL Acid Phosphatase Tritosomes with 25 μL of 0.4 mg/mL siRNA sample in a microcentrifuge tube and incubating for twenty-four hours in an eppendorf Thermomixer set to 37° C. and 300 rpm. After twenty-four hours of incubation 300 μL of Phenomenex Lysis Loading Buffer (Cat. # ALO-8498) and 12.5 μL of a 0.4 mg/mL internal standard siRNA were added to each sample. Time 0 hour samples were prepared by mixing 100 μL of 0.5 units/mL Acid Phosphatase Tritosomes with 25 μL of 0.4 mg/mL siRNA sample, 300 μL of Phenomenex Lysis Loading Buffer, and 12.5 μL of a 0.4 mg/mL internal standard siRNA. siRNA was extracted from twenty-four hour samples and 0 hour samples using a Phenomenex Clarity OTX Starter Kit (Cat. # KSO-8494). After the samples were extracted they were transferred to a microcentrifuge tube and dried down using a Labconco CentriVap Concentrator (Cat. #7810010). The samples were then resuspended with 500 μL of nuclease free water. Fifty μL of each sample was run on an Agilent Technologies 1260 Infinity Binary LC with Agilent Technologies 6130 Quadrupole LC/MS. The Quaternary pump method was run for 12.20 minutes at 0.400 mL/min with the following timetable:

| Time Function | Parameter |
|---|---|
| 0.20 | 5% Buffer A(16 mM TEA 200 mM HFIP), 95% Buffer B (100% Methanol) |
| 2.50 | 5% Buffer A(16 mM TEA 200 mM HFIP), 95% Buffer B (100% Methanol) |
| 3.00 | 100% Buffer A(16 mM TEA 200 mM HFIP) |

The Binary Pump method was run for 12.20 min at 0.700 mL/min with the following timetable

| Time Function | Parameter |
|---|---|
| 0.00 | 100% Buffer A(16 mM TEA 200 mM HFIP) |
| 0.40 | 100% Buffer A(16 mM TEA 200 mM HFIP) |
| 10.00 | 60% Buffer A(16 mM TEA 200 mM HFIP), 40% Buffer B (100% ACN) |
| 10.10 | 100% Buffer A(16 mM TEA 200 mM HFIP) |
| 12.20 | 100% Buffer A(16 mM TEA 200 mM HFIP) |

Both the left and right column was set at 75.00° C. The UV signal was measured at 260 nm wavelength. The percent remaining of each strand was calculated using the following equation:

% Strand remaining=$100*($Peak Area$_{Strand\ 24h}$/Peak Area$_{Strand\ 0h}*($Peak Area$_{Standard\ 24h}$/Peak Area$_{standard\ 0h}))$.

For the cytosol stability assay, female rat liver cytosol (Xenotech Cat. # R1500.C) were thawed to room temperature and diluted to 1 mg/mL in 50 mM Tris buffer: HCl pH 7.4, 5 mM MgCl2. 24 hour samples were prepared by mixing 100 uL of 1 mg/mL Cytosol with 25 uL of 0.4 mg/mL siRNA sample in a microcentrifuge tube and incubating for 24 hours in an eppendorf Thermomixer set to 37° C. and 300 rpm. After 24 hours of incubation 300 uL of Phenomenex Lysis Loading Buffer (Cat. # ALO-8498) and 12.5 uL of a 0.4 mg/mL internal standard siRNA were added to each sample. 0 hour samples were prepared by mixing 100 uL of 1 mg/mL Cytosol with 25 uL of 0.4 mg/mL siRNA sample, 300 uL of Phenomenex Lysis Loading Buffer, and 12.5 uL of a 0.4 mg/mL internal standard siRNA. siRNA was extracted from 24 hour samples and 0 hour samples using a Phenomenex Clarity OTX Starter Kit (Cat. # KSO-8494). After the samples were extracted they were transferred to a microcentrifuge tube and dried down using a Labconco CentriVap Concentrator (Cat. #7810010). The samples were then resuspended with 500 uL of nuclease free water. 50 uL of each sample was run on an Agilent Technologies 1260 Infinity Binary LC with Agilent Technologies 6130 Quadrupole LC/MS. The Quaternary pump method was run for 12.20 minutes at 0.400 mL/min with the following timetable:

| Time Function | Parameter |
|---|---|
| 0.20 | 5% Buffer A(16 mM TEA 200 mM HFIP), 95% Buffer B (100% Methanol) |
| 2.50 | 5% Buffer A(16 mM TEA 200 mM HFIP), 95% Buffer B (100% Methanol) |
| 3.00 | 100% Buffer A(16 mM TEA 200 mM HFIP) |

The Binary Pump method was run for 12.20 min at 0.700 mL/min with the following timetable:
Time FunctionParameter

| Time Function | Parameter |
|---|---|
| 0.00 | 100% Buffer A(16 mM TEA 200 mM HFIP) |
| 0.40 | 100% Buffer A(16 mM TEA 200 mM HFIP) |
| 10.00 | 60% Buffer A(16 mM TEA 200 mM HFIP), 40% Buffer B (100% ACN) |
| 10.10 | 100% Buffer A(16 mM TEA 200 mM HFIP) |
| 12.20 | 100% Buffer A(16 mM TEA 200 mM HFIP) |

Both the left and right column was set at 75.00° C. The UV signal was measured at 260 nm wavelength. The percent remaining of each strand was calculated using the following equation:

% Strand remaining=$100*($Peak Area$_{Strand\ 24h}$/Peak Area$_{strand\ 0h}*($Peak Area$_{Standard\ 24h}$/Peak Area$_{standard\ 0h}))$.

The results of the twenty-four hour tritosome stability assays are provided in Table 9 and the results of the twenty-four hour cytosol stability assays are provided in Table 10.

TABLE 9

Twenty-four hour tritosome stability assays.

| % Antisense Remaining | % Sense Remaining | DuplexID |
|---|---|---|
|  |  | AD-65369 |
| 87.59 | 72.43 | AD-65381 |
|  |  | AD-63962 |
|  |  | AD-63938 |
|  |  | AD-65561 |
| 67.59 | 82.48 | AD-65566 |
|  |  | AD-63944 |
| 30.52 | 34.98 | AD-63968 |
|  |  | AD-65406 |
|  |  | AD-65396 |
| 115.17 | 79.61 | AD-65427 |
| 43.00 | 76.84 | AD-65573 |
|  |  | AD-65432 |
|  |  | AD-64332 |
|  |  | AD-64322 |
| 129.69 | 128.59 | AD-64272 |
|  |  | AD-65583 |
|  |  | AD-63994 |
|  |  | AD-65370 |
|  |  | AD-65265 |
| 100.30 | 119.85 | AD-65407 |
|  |  | AD-64027 |
|  |  | AD-65266 |
|  |  | AD-65389 |
| 94.06 | 110.90 | AD-64008 |
| 98.63 | 127.48 | AD-65377 |
| 105.06 | 119.88 | AD-65409 |
| 117.55 | 104.30 | AD-65403 |
|  |  | AD-65385 |

TABLE 10

Twenty-four hour cytosol stability assays.

| % Antisense Remaining | % Sense Remaining | DuplexID |
|---|---|---|
|  |  | AD-65369 |
| 67.78 | 22.42 | AD-65381 |
|  |  | AD-63962 |
|  |  | AD-63938 |
|  |  | AD-65561 |
| 55.89 | 15.26 | AD-65566 |

TABLE 10-continued

Twenty-four hour cytosol stability assays.

| % Antisense Remaining | % Sense Remaining | DuplexID |
|---|---|---|
|  |  | AD-63944 |
| 88.39 | 46.94 | AD-63968 |
|  |  | AD-65406 |
|  |  | AD-65396 |
| 89.50 | 66.35 | AD-65427 |
| 69.01 | 41.47 | AD-65573 |
|  |  | AD-65432 |
|  |  | AD-64332 |
|  |  | AD-64322 |
| 96.77 | 78.00 | AD-64272 |
|  |  | AD-65583 |
|  |  | AD-63994 |
|  |  | AD-65370 |
|  |  | AD-65265 |
| 64.46 | 24.10 | AD-65407 |
|  |  | AD-64027 |
|  |  | AD-65266 |
|  |  | AD-65389 |
| 35.39 | 26.39 | AD-64008 |
| 79.98 | 66.50 | AD-65377 |
| 86.24 | 74.25 | AD-65409 |
| 60.45 | 62.41 | AD-65403 |
|  |  | AD-65385 |

Example 4. Synthesis and In Vitro Screening of iRNA Duplexes Targeting HDV

The selection of iRNA designs targeting HDV was driven by two primary factors: a) potency and b), the desire to employ iRNA with near-perfect matches with greater than 90% fractional coverage of the large number of public HDV sequences of all known clades (I-VIII or 1-8). However, due to the low level of conservation between members of the various HDV clades and the small genome, selection of sequences that effectively target multiple HDV clades was difficult. Exemplary sequences for the various HDV clades 1-8 are provided in SEQ ID NOs: 29, 31, 33, 35, 37, 39, 41, and 43. Their reverse complements are provided in SEQ ID NOs: 30, 32, 34, 36, 38, 40, 42, and 44.

iRNA molecules targeting the HDV genome were synthesized as described above. A detailed list of the unmodified HDV sense and antisense strand sequences is shown in Table 11 and a detailed list of the modified HDV sense and antisense strand sequences is shown in Table 12. The results of a single dose screen of these agents using the Dual-Glo Luciferase® Assay described above are shown in Table 13.

TABLE 11

Unmodified Sense and Antisense Strand Sequences of HDV dsRNAs

| Duplex Name | Sense Strand | Antisense Strand | Clade | Sense Seq | Antisense Seq | SEQ ID NO Sense/Antisense |
|---|---|---|---|---|---|---|
| AD-45013.1 | A-94349.1 | A-94350.1 | HDV1 | ACGAAGGAAGGCCCUCGAGdTdT | CUCGAGGGCCUUCCUUCGUdTdT | 45/46 |
| AD-45019.1 | A-94351.1 | A-94352.1 | HDV1 | CGAAGGAAGGCCCUCGAGAdTdT | UCUCGAGGGCCUUCCUUCGdTdT | 47/48 |
| AD-45025.1 | A-94353.1 | A-94354.1 | HDV1 | GAAGGAAGGCCCUCGAGAAdTdT | UUCUCGAGGGCCUUCCUUCdTdT | 49/50 |
| AD-45036.1 | A-94357.1 | A-94358.1 | HDV1 | AGGAAGGCCCUCGAGAACAdTdT | UGUUCUCGAGGGCCUUCCUdTdT | 51/52 |
| AD-45041.1 | A-94359.1 | A-94360.1 | HDV1 | GGAAGGCCCUCGAGAACAAdTdT | UUGUUCUCGAGGGCCUUCCdTdT | 53/54 |
| AD-45046.1 | A-94361.1 | A-94362.1 | HDV1 | GAAGGCCCUCGAGAACAAGdTdT | CUUGUUCUCGAGGGCCUUCdTdT | 55/56 |

TABLE 11-continued

Unmodified Sense and Antisense Strand Sequences of HDV dsRNAs

| Duplex Name | Sense Strand | Antisense Strand | Clade | Sense Seq | Antisense Seq | SEQ ID NO Sense/ Anti-sense |
|---|---|---|---|---|---|---|
| AD-45051.1 | A-94363.1 | A-94364.1 | HDV1 | GGGGUGUGAACCCCCUCGAdTdT | UCGAGGGGGUUCACACCCCdTdT | 57/58 |
| AD-45014.1 | A-94365.1 | A-94366.1 | HDV1 | GGGUGUGAACCCCCUCGAAdTdT | UUCGAGGGGGUUCACACCCdTdT | 59/60 |
| AD-45020.1 | A-94367.1 | A-94368.1 | HDV1 | GGUGUGAACCCCCUCGAAGdTdT | CUUCGAGGGGGUUCACACCdTdT | 61/62 |
| AD-45026.1 | A-94369.1 | A-94370.1 | HDV1 | UGUGAACCCCCUCGAAGGUdTdT | ACCUUCGAGGGGGUUCACAdTdT | 63/64 |
| AD-45032.1 | A-94371.1 | A-94372.1 | HDV2 | AAAAUCCCUGGCUGGGGAAdTdT | UUCCCCAGCCAGGGAUUUUdTdT | 65/66 |
| AD-45042.1 | A-94375.1 | A-94376.1 | HDV2 | AAUCCCUGGCUGGGGAACAdTdT | UGUUCCCCAGCCAGGGAUUdTdT | 67/68 |
| AD-45047.1 | A-94377.1 | A-94378.1 | HDV2 | AUCCCUGGCUGGGGAACAUdTdT | AUGUUCCCCAGCCAGGGAUdTdT | 69/70 |
| AD-45015.1 | A-94381.1 | A-94382.1 | HDV2 | AAGAGCGGGUUCACCGACAdTdT | UGUCGGUGAACCCGCUCUUdTdT | 71/72 |
| AD-45021.1 | A-94383.1 | A-94384.1 | HDV2 | AGAGCGGGUUCACCGACAAdTdT | UUGUCGGUGAACCCGCUCUdTdT | 73/74 |
| AD-45027.1 | A-94385.1 | A-94386.1 | HDV2 | GAGCGGGUUCACCGACAAGdTdT | CUUGUCGGUGAACCCGCUCdTdT | 75/76 |
| AD-45033.1 | A-94387.1 | A-94388.1 | HDV2 | GCGGGUUCACCGACAAGGAdTdT | UCCUUGUCGGUGAACCCGCdTdT | 77/78 |
| AD-45038.1 | A-94389.1 | A-94390.1 | HDV2 | CGGGUUCACCGACAAGGAGdTdT | CUCCUUGUCGGUGAACCCGdTdT | 79/80 |
| AD-45043.1 | A-94391.1 | A-94392.1 | HDV2 | GGGUUCACCGACAAGGAGAdTdT | UCUCCUUGUCGGUGAACCCdTdT | 81/82 |
| AD-45048.1 | A-94393.1 | A-94394.1 | HDV2 | GGUUCACCGACAAGGAGAGdTdT | CUCUCCUUGUCGGUGAACCdTdT | 83/84 |
| AD-45053.1 | A-94395.1 | A-94396.1 | HDV2 | GGGAGGGACUGGACAUCAGdTdT | CUGAUGUCCAGUCCCUCCCdTdT | 85/86 |
| AD-45016.1 | A-94397.1 | A-94398.1 | HDV3 | GGGUAGAGGAAAGGAAGAAdTdT | UUCUUCCUUUCCUCUACCCdTdT | 87/88 |
| AD-45022.1 | A-94399.1 | A-94400.1 | HDV3 | GAGGCGGGACCACAGAAGAdTdT | UCUUCUGUGGUCCCGCCUCdTdT | 89/90 |
| AD-45028.1 | A-94401.1 | A-94402.1 | HDV3 | ACAGAAGAAGGAAGGCCCUdTdT | AGGGCCUUCCUUCUUCUGUdTdT | 91/92 |
| AD-45034.1 | A-94403.1 | A-94404.1 | HDV3 | GAAGAAGAGGAACUCCGGAdTdT | UCCGGAGUUCCUCUUCUUCdTdT | 93/94 |
| AD-45039.1 | A-94405.1 | A-94406.1 | HDV3 | CAGGGAUGACGACGAAAGAdTdT | UCUUUCGUCGUCAUCCCUGdTdT | 95/96 |
| AD-45044.1 | A-94407.1 | A-94408.1 | HDV3 | GGGAUGACGACGAAAGAGAdTdT | UCUCUUUCGUCGUCAUCCCdTdT | 97/98 |
| AD-45049.1 | A-94409.1 | A-94410.1 | HDV3 | GGAUGACGACGAAAGAGAAdTdT | UUCUCUUUCGUCGUCAUCCdTdT | 99/100 |
| AD-45054.1 | A-94411.1 | A-94412.1 | HDV3 | CCUGGGGGUGUGAACCCAAdTdT | UUGGGUUCACACCCCCAGGdTdT | 101/102 |
| AD-45017.1 | A-94413.1 | A-94414.1 | HDV3 | CUGGGGGUGUGAACCCAAUdTdT | AUUGGGUUCACACCCCCAGdTdT | 103/104 |
| AD-45023.1 | A-94415.1 | A-94416.1 | HDV3 | CCUUUUCCCGAACGGGAGAdTdT | UCUCCCGUUCGGGAAAAGGdTdT | 105/106 |
| AD-45035.1 | A-94419.1 | A-94420.1 | HDV3 | GAACGGGAGAGGGGAUCGAdTdT | UCGAUCCCCUCUCCCGUUCdTdT | 107/108 |
| AD-45040.1 | A-94421.1 | A-94422.1 | HDV3 | ACGGGAGAGGGGAUCGACAdTdT | UGUCGAUCCCCUCUCCCGUdTdT | 109/110 |
| AD-45050.1 | A-94425.1 | A-94426.1 | HDV3 | AGAGGGGAUCGACAUCCGAdTdT | UCGGAUGUCGAUCCCCUCUdTdT | 111/112 |
| AD-45055.1 | A-94427.1 | A-94428.1 | HDV3 | GGGGAUCGACAUCCGAGGAdTdT | UCCUCGGAUGUCGAUCCCCdTdT | 113/114 |
| AD-45018.1 | A-94429.1 | A-94430.1 | HDV3 | GGGAUCGACAUCCGAGGAAdTdT | UUCCUCGGAUGUCGAUCCCdTdT | 115/116 |
| AD-45024.1 | A-94431.1 | A-94432.1 | HDV3 | ACAUCCGAGGAACCCAGCAdTdT | UGCUGGGUUCCUCGGAUGUdTdT | 117/118 |
| AD-45030.1 | A-94433.1 | A-94434.1 | HDV3 | GGAACCCAGCAGUUCCCAUdTdT | AUGGGAACUGCUGGGUUCCdTdT | 119/120 |

TABLE 12

Modified Sense and Antisense Strand Sequences of HDV dsRNAs

| Duplex Name | Sense Strand | Antisense Strand | Clade | Sense Sequence (5' to 3') | SEQ ID NO: | Antisense Sequence (5' to 3') | SEQ ID NO: |
|---|---|---|---|---|---|---|---|
| AD-45013.1 | A-94349.1 | A-94350.1 | HDV1 | AcGAAGGAAGGcccucGAGdTsdT | 1487 | CUCGAGGGCCUUCCUUCGUdTsdT | 1525 |
| AD-45019.1 | A-94351.1 | A-94352.1 | HDV1 | cGAAGGAAGGcccucGAGAdTsdT | 1488 | UCUCGAGGGCCUUCCUUCGdTsdT | 1526 |
| AD-45025.1 | A-94353.1 | A-94354.1 | HDV1 | GAAGGAAGGcccucGAGAAdTsdT | 1489 | UUCUCGAGGGCCUUCCUUCdTsdT | 1527 |
| AD-45036.1 | A-94357.1 | A-94358.1 | HDV1 | AGGAAGGcccucGAGAAcAdTsdT | 1490 | UGUUCUCGAGGGCCUUCCUdTsdT | 1528 |
| AD-45041.1 | A-94359.1 | A-94360.1 | HDV1 | GGAAGGcccucGAGAAcAAdTsdT | 1491 | UUGUUCUCGAGGGCCUUCCdTsdT | 1529 |
| AD-45046.1 | A-94361.1 | A-94362.1 | HDV1 | GAAGGcccucGAGAAcAAGdTsdT | 1492 | CUUGUUCUCGAGGGCCUUCdTsdT | 1530 |
| AD-45051.1 | A-94363.1 | A-94364.1 | HDV1 | GGGGuGuGAAccccucGAdTsdT | 1493 | UCGAGGGGGUUcAcACCCCdTsdT | 1531 |
| AD-45014.1 | A-94365.1 | A-94366.1 | HDV1 | GGGuGuGAAccccucGAAdTsdT | 1494 | UUCGAGGGGGUUcAcACCCdTsdT | 1532 |
| AD-45020.1 | A-94367.1 | A-94368.1 | HDV1 | GGuGuGAAccccucGAAGdTsdT | 1495 | CUUCGAGGGGGUUcAcACCdTsdT | 1533 |
| AD-45026.1 | A-94369.1 | A-94370.1 | HDV1 | uGuGAAccccucGAAGGudTsdT | 1496 | ACCUUCGAGGGGGUUcAcAdTsdT | 1534 |
| AD-45032.1 | A-94371.1 | A-94372.1 | HDV2 | AAAAucccuGGcuGGGGAAdTsdT | 1497 | UUCCCcAGCcAGGGAUUUUdTsdT | 1535 |
| AD-45042.1 | A-94375.1 | A-94376.1 | HDV2 | AAucccuGGcuGGGGAAcAdTsdT | 1498 | UGUUCCCcAGCcAGGGAUUdTsdT | 1536 |
| AD-45047.1 | A-94377.1 | A-94378.1 | HDV2 | AucccuGGcuGGGGAAcAudTsdT | 1499 | AUGUUCCCcAGCcAGGGAUdTsdT | 1537 |
| AD-45015.1 | A-94381.1 | A-94382.1 | HDV2 | AAGAGcGGGuucAccGAcAdTsdT | 1500 | UGUCGGUGAACCCGCUCUUdTsdT | 1538 |
| AD-45021.1 | A-94383.1 | A-94384.1 | HDV2 | AGAGcGGGuucAccGAcAAdTsdT | 1501 | UUGUCGGUGAACCCGCUCUdTsdT | 1539 |
| AD-45027.1 | A-94385.1 | A-94386.1 | HDV2 | GAGcGGGuucAccGAcAAGdTsdT | 1502 | CUUGUCGGUGAACCCGCUCdTsdT | 1540 |
| AD-45033.1 | A-94387.1 | A-94388.1 | HDV2 | GcGGGuucAccGAcAAGGAdTsdT | 1503 | UCCUUGUCGGUGAACCCGCdTsdT | 1541 |
| AD-45038.1 | A-94389.1 | A-94390.1 | HDV2 | cGGGuucAccGAcAAGGAGdTsdT | 1504 | CUCCUUGUCGGUGAACCCGdTsdT | 1542 |
| AD-45043.1 | A-94391.1 | A-94392.1 | HDV2 | GGGuucAccGAcAAGGAGdTsdT | 1505 | UCUCCUUGUCGGUGAACCCdTsdT | 1543 |
| AD-45048.1 | A-94393.1 | A-94394.1 | HDV2 | GGuucAccGAcAAGGAGAdTsdT | 1506 | CUCUCCUUGUCGGUGAACCdTsdT | 1544 |
| AD-45053.1 | A-94395.1 | A-94396.1 | HDV2 | GGGAGGGAcuGGAcAucAGdTsdT | 1507 | CUGAUGUCcAGUCCCUCCCdTsdT | 1545 |
| AD-45016.1 | A-94397.1 | A-94398.1 | HDV3 | GGGuAGAGGAAAGGAAGAAdTsdT | 1508 | UUCUUCCUUUCCUCuACCCdTsdT | 1546 |
| AD-45022.1 | A-94399.1 | A-94400.1 | HDV3 | GAGGcGGGAccAcAGAAGAdTsdT | 1509 | UCUUCUGUGGUCCCGCCUCdTsdT | 1547 |
| AD-45028.1 | A-94401.1 | A-94402.1 | HDV3 | AcAGAAGAAGGAAGGcccudTsdT | 1510 | AGGGCCUUCCUUCUUCUGUdTsdT | 1548 |
| AD-45034.1 | A-94403.1 | A-94404.1 | HDV3 | GAAGAAGAGGAAcuccGGAdTsdT | 1511 | UCCGGAGUUCCUCUUCUUCdTsdT | 1549 |
| AD-45039.1 | A-94405.1 | A-94406.1 | HDV3 | cAGGGAuGAcGAcGAAAGAdTsdT | 1512 | UCUUUCGUCGUcAUCCCUGdTsdT | 1550 |
| AD-45044.1 | A-94407.1 | A-94408.1 | HDV3 | GGGAuGAcGAcGAAAGAGAdTsdT | 1513 | UCUCUUUCGUCGUcAUCCCdTsdT | 1551 |
| AD-45049.1 | A-94409.1 | A-94410.1 | HDV3 | GGAuGAcGAcGAAAGAGAAdTsdT | 1514 | UUCUCUUUCGUCGUcAUCCdTsdT | 1552 |
| AD-45054.1 | A-94411.1 | A-94412.1 | HDV3 | ccuGGGGGuGuGAAcccAAdTsdT | 1515 | UUGGGUUcAcACCCCcAGGdTsdT | 1553 |
| AD-45017.1 | A-94413.1 | A-94414.1 | HDV3 | cuGGGGGuGuGAAcccAAudTsdT | 1516 | AUUGGGUUcAcACCCCcAGdTsdT | 1554 |
| AD-45023.1 | A-94415.1 | A-94416.1 | HDV3 | ccuuuucccGAAcGGGAGAdTsdT | 1517 | UCUCCCGUUCGGGAAAAGGdTsdT | 1555 |
| AD-45035.1 | A-94419.1 | A-94420.1 | HDV3 | GAAcGGGAGAGGGGAucGAdTsdT | 1518 | UCGAUCCCCUCUCCCGUUCdTsdT | 1556 |
| AD-45040.1 | A-94421.1 | A-94422.1 | HDV3 | AcGGGAGAGGGGAucGAcAdTsdT | 1519 | UGUCGAUCCCCUCUCCCGUdTsdT | 1557 |
| AD-45050.1 | A-94425.1 | A-94426.1 | HDV3 | AGAGGGGAucGAcAuccGAdTsdT | 1520 | UCGGAuGUCGAUCCCCUCUdTsdT | 1558 |
| AD-45055.1 | A-94427.1 | A-94428.1 | HDV3 | GGGGAucGAcAuccGAGGAdTsdT | 1521 | UCCUCGGAuGUCGAUCCCCdTsdT | 1559 |
| AD-45018.1 | A-94429.1 | A-94430.1 | HDV3 | GGGAucGAcAuccGAGGAAdTsdT | 1522 | UUCCUCGGAuGUCGAUCCCdTsdT | 1560 |

TABLE 12-continued

Modified Sense and Antisense Strand Sequences of HDV dsRNAs

| Duplex Name | Sense Strand | Antisense Strand | Clade | Sense Sequence (5' to 3') | SEQ ID NO: | Antisense Sequence (5' to 3') | SEQ ID NO: |
|---|---|---|---|---|---|---|---|
| AD-45024.1 | A-94431.1 | A-94432.1 | HDV3 | AcAuccGAGGAAcccAGcAdTsdT | 1523 | UGCUGGGUUCCUCGGAUGUdTsdT | 1561 |
| AD-45030.1 | A-94433.1 | A-94434.1 | HDV3 | GGAAcccAGcAGuucccAudTsdT | 1524 | AUGGGAACUGCUGGGUUCCdTsdT | 1562 |

TABLE 13

HDV single dose screen using Dual-Glo Luciferase ® Assay

| Duplex Name | 10 nM mean KD | 0.1 nM mean KD | Sense Strand | Antisense Strand | Clade |
|---|---|---|---|---|---|
| AD-45013.1 | 0.564 | 0.885 | A-94349.1 | A-94350.1 | HDV1 |
| AD-45019.1 | 0.238 | 0.749 | A-94351.1 | A-94352.1 | HDV1 |
| AD-45025.1 | 0.203 | 0.747 | A-94353.1 | A-94354.1 | HDV1 |
| AD-45036.1 | 0.557 | 0.865 | A-94357.1 | A-94358.1 | HDV1 |
| AD-45041.1 | 0.710 | 0.865 | A-94359.1 | A-94360.1 | HDV1 |
| AD-45046.1 | 0.849 | 0.937 | A-94361.1 | A-94362.1 | HDV1 |
| AD-45051.1 | 0.863 | 0.909 | A-94363.1 | A-94364.1 | HDV1 |
| AD-45014.1 | 0.556 | 0.883 | A-94365.1 | A-94366.1 | HDV1 |
| AD-45020.1 | 0.860 | 0.949 | A-94367.1 | A-94368.1 | HDV1 |
| AD-45026.1 | 0.793 | 0.847 | A-94369.1 | A-94370.1 | HDV1 |
| AD-45032.1 | 0.569 | 0.878 | A-94371.1 | A-94372.1 | HDV2 |
| AD-45042.1 | 0.913 | 0.928 | A-94375.1 | A-94376.1 | HDV2 |
| AD-45047.1 | 0.593 | 0.858 | A-94377.1 | A-94378.1 | HDV2 |
| AD-45015.1 | 0.615 | 0.948 | A-94381.1 | A-94382.1 | HDV2 |
| AD-45021.1 | 0.856 | 0.903 | A-94383.1 | A-94384.1 | HDV2 |
| AD-45027.1 | 1.001 | 0.934 | A-94385.1 | A-94386.1 | HDV2 |
| AD-45033.1 | 0.926 | 0.939 | A-94387.1 | A-94388.1 | HDV2 |
| AD-45038.1 | 0.838 | 0.876 | A-94389.1 | A-94390.1 | HDV2 |
| AD-45043.1 | 0.721 | 0.949 | A-94391.1 | A-94392.1 | HDV2 |
| AD-45048.1 | 0.873 | 0.927 | A-94393.1 | A-94394.1 | HDV2 |
| AD-45053.1 | 0.415 | 0.826 | A-94395.1 | A-94396.1 | HDV2 |
| AD-45016.1 | 0.634 | 0.917 | A-94397.1 | A-94398.1 | HDV3 |
| AD-45022.1 | 0.943 | 0.900 | A-94399.1 | A-94400.1 | HDV3 |
| AD-45028.1 | 0.817 | 0.914 | A-94401.1 | A-94402.1 | HDV3 |
| AD-45034.1 | 0.601 | 0.890 | A-94403.1 | A-94404.1 | HDV3 |
| AD-45039.1 | 0.931 | 0.888 | A-94405.1 | A-94406.1 | HDV3 |
| AD-45044.1 | 0.912 | 0.905 | A-94407.1 | A-94408.1 | HDV3 |
| AD-45049.1 | 0.976 | 0.980 | A-94409.1 | A-94410.1 | HDV3 |
| AD-45054.1 | 0.929 | 0.896 | A-94411.1 | A-94412.1 | HDV3 |
| AD-45017.1 | 0.977 | 0.974 | A-94413.1 | A-94414.1 | HDV3 |
| AD-45023.1 | 0.887 | 0.878 | A-94415.1 | A-94416.1 | HDV3 |
| AD-45035.1 | 0.915 | 0.928 | A-94419.1 | A-94420.1 | HDV3 |
| AD-45040.1 | 1.671 | 0.934 | A-94421.1 | A-94422.1 | HDV3 |
| AD-45050.1 | 0.878 | 0.963 | A-94425.1 | A-94426.1 | HDV3 |
| AD-45055.1 | 0.926 | 0.873 | A-94427.1 | A-94428.1 | HDV3 |
| AD-45018.1 | 0.912 | 0.976 | A-94429.1 | A-94430.1 | HDV3 |
| AD-45024.1 | 0.873 | 0.884 | A-94431.1 | A-94432.1 | HDV3 |
| AD-45030.1 | 0.909 | 0.937 | A-94433.1 | A-94434.1 | HDV3 |

Example 5. Synthesis and Screening of Additional siRNA Duplexes Targeted to HBV

Additional iRNA molecules targeting the HBV genome were designed and synthesized as described above. A detailed list of the additional unmodified HBV sense and antisense strand sequences is shown in Table 14 and a detailed list of the modified HBV sense and antisense strand sequences is shown in Table 15.

TABLE 14

Unmodified Sense and Antisense Strand Sequences of HBV dsRNAs

| Duplex ID | Sense ID | Sense Sequence (5' to 3') | SEQ ID NO: | Antisense ID | Antisense Sequence (5' to 3') | SEQ ID NO: |
|---|---|---|---|---|---|---|
| AD-65381 | A-130366.9 | UCGUGGUGGACUUCUCUCA | 1563 | A-131904.1 | UGAGAGAAGUCCACCACGAUU | 1574 |
| AD-66019 | A-130366.9 | UCGUGGUGGACUUCUCUCA | 1564 | A-131904.1 | UGAGAGAAGUCCACCACGAUU | 1575 |
| AD-65375 | A-130366.9 | UCGUGGUGGACUUCUCUCA | 1565 | A-130364.7 | UGAGAGAAGUCCACCACGAUU | 1576 |
| AD-65427 | A-130441.7 | GUGCACUUCGCUUCACCUCUA | 1566 | A-131905.1 | UAGAGGUGAAGCGAAGUGCACUU | 1577 |
| AD-66110 | A-130441.7 | GUGCACUUCGCUUCACCUCUA | 1567 | A-131905.1 | UAGAGGUGAAGCGAAGUGCACUU | 1578 |
| AD-65421 | A-130441.7 | GUGCACUUCGCUUCACCUCUA | 1568 | A-130442.6 | UAGAGGUGAAGCGAAGUGCACUU | 1579 |
| AD-65407 | A-130371.12 | CGUGGUGGACUUCUCUCAAUU | 1569 | A-130372.5 | AAUUGAGAGAAGUCCACCAGCAG | 1580 |
| AD-65377 | A-130384.4 | CGUGGUGGUCUUCUCUAAAUU | 1570 | A-130748.3 | AAUUGAGAGAAGUCCACCAGCUU | 1581 |
| AD-65409 | A-130388.15 | GGUGGACUUCUCUCAAUUUA | 1571 | A-131906.1 | UAAAAUUGAGAGAAGUCCACCAC | 1582 |
| AD-66111 | A-130388.15 | GGUGGACUUCUCUCAAUUUA | 1572 | A-131906.1 | UAAAAUUGAGAGAAGUCCACCAC | 1583 |
| AD-65403 | A-130388.15 | GGUGGACUUCUCUCAAUUUA | 1573 | A-130389.4 | UAAAAUUGAGAGAAGUCCACCAC | 1584 |

TABLE 15

Modified Sense and Antisense Strand Sequences of HBV dsRNAs

| Duplex ID | Sense ID | Sense Sequence (5' to 3') | SEQ ID NO: |
|---|---|---|---|
| AD-65381 | A-130366.9 | uscsguGfgUfGfGfacuucucucaL96 | 1585 |
| AD-66019 | A-130366.9 | uscsguGfgUfGfGfacuucucucaL96 | 1586 |
| AD-65375 | A-130366.9 | uscsguGfgUfGfGfacuucucucaL96 | 1587 |
| AD-65427 | A-130441.7 | gsusgcacUfuCfGfCfuucaccucuaL96 | 1588 |
| AD-66110 | A-130441.7 | gsusgcacUfuCfGfCfuucaccucuaL96 | 1589 |
| AD-65421 | A-130441.7 | gsusgcacUfuCfGfCfuucaccucuaL96 | 1590 |
| AD-65407 | A-130371.12 | csgsugguGfgAfCfUfucucUfCfaauuL96 | 1591 |
| AD-65377 | A-130384.4 | csgsuggudGgucdTucucuaaauuL96 | 1592 |
| AD-65409 | A-130388.15 | gsgsuggaCfuUfCfUfcucaAfUfuuuaL96 | 1593 |
| AD-66111 | A-130388.15 | gsgsuggaCfuUfCfUfcucaAfUfuuuaL96 | 1594 |
| AD-65403 | A-130388.15 | gsgsuggaCfuUfCfUfcucaAfUfuuuaL96 | 1595 |

| Duplex ID | Antisense ID | Antisense Sequence (5' to 3') | SEQ ID NO: |
|---|---|---|---|
| AD-65381 | A-131904.1 | PusGfsagaGfaAfGfuccaCfcAfcgasusu | 1596 |
| AD-66019 | A-131904.1 | VPusGfsagaGfaAfGfuccaCfcAfcgasusu | 1597 |
| AD-65375 | A-130364.7 | usGfsagaGfaAfGfuccaCfcAfcgasusu | 1598 |
| AD-65427 | A-131905.1 | PusAfsgagGfugaagcgAfaGfugcacsusu | 1599 |
| AD-66110 | A-131905.1 | VPusAfsgagGfugaagcgAfaGfugcacsusu | 1600 |
| AD-65421 | A-130442.6 | usAfsgagGfugaagcgAfaGfugcacsusu | 1601 |
| AD-65407 | A-130372.5 | asAfsuugAfgAfgAfaguCfcAfccagcsasg | 1602 |
| AD-65377 | A-130748.3 | asdAsuugagagdAagudCcaccagcsusu | 1603 |
| AD-65409 | A-131906.1 | PusAfsaaaUfuGfAfgagaAfgUfccaccsasc | 1604 |
| AD-66111 | A-131906.1 | VPusAfsaaaUfuGfAfgagaAfgUfccaccsasc | 1605 |
| AD-65403 | A-130389.4 | usAfsaaaUfuGfAfgagaAfgUfccaccsasc | 1606 |

A primary single dose screen of these iRNA duplexes was performed using the Dual-Glo® Luciferase assay, as described above. The results of this screen in Cos7 cells transfected with the indicated HBV iRNAs are shown in Table 16. Data are expressed as percent of mRNA remaining relative to negative control at 24 hours.

TABLE 16

HBV single dose primary screen In Cos7 cells using Dual-Glo Luciferase ® Assay

| | Dual luciferase primary screen | | | | DRC ED50 (nM) |
|---|---|---|---|---|---|
| | % Message remaining at 24 hr | | | | |
| Duplex ID | at 50 nM | STDEV | at 1 nM | STDEV | |
| AD-65381 | 9.3 | 0.24 | 15.6 | 0.77 | 0.019 |
| AD-66019 | ND | ND | ND | ND | ND |
| AD-65375 | 24.2 | 0.36 | 71.4 | 0.69 | No ED50 |
| AD-65427 | 28.8 | 1.60 | 41.0 | 1.73 | 0.117 |
| AD-66110 | ND | ND | ND | ND | ND |
| AD-65421 | 47.6 | 3.49 | 85.5 | 4.76 | No ED50 |
| AD-65407 | 14.3 | 0.52 | 25.3 | 2.11 | 0.038 |
| AD-65377 | 21.8 | 0.31 | 37.9 | 1.12 | 0.130 |
| AD-65409 | 9.5 | 0.41 | 13.2 | 0.71 | 0.013 |
| AD-66111 | ND | ND | ND | ND | ND |
| AD-65403 | 12.6 | 0.50 | 37.2 | 2.31 | 0.069 |

ND—not done

These duplexes were also assayed for dose response for silencing viral RNA using the Dual-Glo® Luciferase assay, as described above. The doses of the duplexes used for these asaays were 50 nM, 8.333333333 nM, 1.388888889 nM, 0.231481481 nM, 0.038580247 nM, 0.006430041 nM, 0.001071674 nM, 0.000178612 nM, 2.97687×10$^{-5}$ nM, 4.96145×10$^{-6}$ nM, 8.26909×10$^{-7}$ nM, and 1.37818E×10$^{-7}$ nM, which represent a 1 to 6 dilution of the duplexes starting at 50 nM over 12 doses. The results of this screen in Cos7 cells transfected with the indicated HBV iRNAs are shown in Table 17. Data are expressed as percent of mRNA remaining relative to negative control at 24 hours.

TABLE 17

Dose response screen In Cos7 cells using Dual-Glo Luciferase ® Assay
Dual luciferase HBV reporter cells
IC50 (nM) at 24 hr

| Duplex ID | Assay 1 | Assay 2 | Assay 3 | Assay 4 | Assay 5 | Assay 6 | Assay 7 | Average[1] | Stdev |
|---|---|---|---|---|---|---|---|---|---|
| AD-65381 | 0.019 | ND | ND | ND | ND | ND | ND | 0.019 | |
| AD-66019 | ND | 0.021 | 0.021 | 0.016 | 0.026 | 0.019 | 0.031 | 0.022 | 0.005 |
| AD-65375 | UD | 0.215 | 0.149 | 0.081 | 0.246 | 0.138 | 0.276 | 0.184 | 0.074 |
| AD-65407 | 0.038 | 0.045 | 0.051 | 0.021 | 0.050 | 0.056 | 0.068 | 0.047 | 0.015 |
| AD-65377 | 0.130 | 0.029 | 0.046 | 0.087 | 0.096 | 0.146 | 0.090 | 0.089 | 0.042 |
| AD-65409 | 0.013 | ND | ND | ND | ND | ND | ND | 0.013 | |
| AD-66111 | ND | 0.018 | 0.013 | 0.012 | 0.018 | 0.021 | 0.033 | 0.019 | 0.007 |
| AD-65403 | 0.069 | 0.044 | 0.033 | 0.039 | 0.042 | 0.046 | 0.062 | 0.048 | 0.013 |
| AD-65427 | 0.017 | ND | ND | ND | ND | ND | ND | 0.117 | |
| AD-66110 | ND | 0.238 | 0.296 | 0.145 | 0.157 | 0.161 | ND | 0.199 | 0.065 |
| AD-65421 | UD | 1.219 | 1.385 | 2.254 | 0.799 | 2.906 | ND | 1.713 | 0.852 |

[1]Averages from 5-7 biological replicates run in triplicate
ND—not done

The in vitro efficacy and potency of these duplexes were also assayed. In particular, the dose response of the duplexes for silencing viral RNA in transfected HepG2.2.15 and Hep3B cell lysates and for silencing HBsAg in HepG2.2.15 cell supernatants were determined. Cells were transfected with 12 separate doses of the duplexes ranging from 50 nM to $1 \times 10^{-7}$ nM and at seventy-two hours after transfection, the level of viral RNA was determined using primer/probe pairs to detect the P ORF and/or the S ORF. The level of HBsAg was determined using an ELISA assay.

The results of the P ORF viral RNA silencing in HepG2.2.15 cells using the indicated duplexes are provided in Table 18. The results of the S ORF viral RNA silencing in HepG2.2.15 cells using the indicated duplexes are provided in Table 19. The results of HBsAg silencing in HepG2.2.15 cells are provided in Table 20.

The results of the P ORF viral RNA silencing in Hep3B cells using the indicated duplexes are provided in Table 21.

TABLE 18

Dose response screen In HepG2.2.15 cells
Viral RNA silencing in HepG2.2.15 cells
P-ORF primer/probe set
IC50 (nM) at 72 hr

| Duplex ID | Assay Development | | Optimized Assay | | | | |
|---|---|---|---|---|---|---|---|
| | | | Assay 1 | Assay 2 | Assay 3 | | |
| AD-65381 | 0.079 | 0.208 | ND | ND | ND | ND | ND |
| AD-66019 | ND | ND | 0.265 | 0.010 | 0.022 | 0.032 | 0.023 |
| AD-65375 | 12.3 | UD | UD | UD | 0.172 | 0.257 | 0.672 |
| AD-65407 | 0.247 | 1.0 | 0.365 | 0.109 | 0.069 | 0.103 | 0.095 |
| AD-65377 | 1.3 | UD | 4.9 | UD | 0.842 | 0.838 | 0.615 |
| AD-65409 | 0.436 | 1.0 | ND | ND | ND | ND | ND |
| AD-66111 | ND | ND | 0.456 | 0.030 | 50 | 0.294 | ND |
| AD-65403 | 9.2 | 10.4 | 3.4 | UD | 0.114 | 0.384 | 1.0 |
| AD-65427 | 0.007 | 0.018 | ND | ND | ND | ND | ND |
| AD-66110 | ND | ND | 0.012 | 0.053 | 0.016 | 0.010 | 0.021 |
| AD-65421 | 0.069 | 0.091 | 0.034 | 0.006 | 0.002 | 0.003 | 0.007 |

ND—not done

TABLE 19

Dose response screen In HepG2.2.15 cells
Viral RNA silencing in HepG2.2.15 cells
S-ORF primer/probe set
IC50 (nM) at 72 hr

| Duplex ID | Assay Development | | | | Optimized Assay | | |
|---|---|---|---|---|---|---|---|
| | | | | | Assay 1 | Assay 2 | Assay 3 |
| AD-65381 | 0.252 | 0.215 | ND | ND | ND | ND | ND |
| AD-66019 | ND | ND | 0.245 | 0.011 | 0.009 | 0.016 | 0.005 |
| AD-65375 | 45 | UD | UD | UD | 0.124 | 0.048 | 0.056 |
| AD-65407 | 0.232 | 0.645 | 0.577 | 0.015 | 0.021 | 0.023 | 0.016 |
| AD-65377 | 1.4 | 8.6 | UD | UD | 0.575 | 0.483 | 0.117 |
| AD-65409 | 0.433 | 0.242 | ND | ND | ND | ND | ND |
| AD-66111 | ND | ND | 2.1 | 0.455 | ND | 0.416 | ND |
| AD-65403 | 0.997 | 0.670 | 0.668 | UD | 0.074 | 0.270 | 1.1 |
| AD-65427 | 0.008 | 0.018 | ND | ND | ND | ND | ND |
| AD-66110 | ND | ND | 0.022 | 0.050 | 0.035 | 0.038 | 0.020 |
| AD-65421 | 0.083 | 0.097 | 0.046 | 0.003 | 0.003 | 0.005 | 0.001 |

ND—not done

TABLE 20

Dose response screen In HepG2.2.15 cells
HBsAg ELISA
IC50 (nM)

| Duplex ID | Assay 1 |
|---|---|
| AD-65381 | ND |
| AD-66019 | 0.105 |
| AD-65375 | 1.2 |
| AD-65407 | 0.102 |
| AD-65377 | 2.9 |
| AD-65409 | ND |
| AD-66111 | 0.018 |
| AD-65403 | 0.064 |
| AD-65427 | ND |
| AD-66110 | 0.002 |
| AD-65421 | 0.008 |

ND—not done

TABLE 21

Dose response screen In Hep3B cells

| | Hep3B cells screen DRC ED50 P-ORF primer/probe set | | |
|---|---|---|---|
| Duplex ID | P-ORF run 1 | P-ORF run 2 | Combined |
| AD-65381 | 0.239 | 0.110 | 0.194 |
| AD-66019 | ND | ND | ND |
| AD-65375 | ND | ND | ND |
| AD-65427 | 0.023 | 0.006 | 0.018 |
| AD-66110 | ND | ND | ND |
| AD-65421 | ND | ND | ND |
| AD-65407 | 0.140 | 1.383 | 0.527 |
| AD-65377 | No ED50 | No ED50 | No ED50 |
| AD-65409 | 1.807 | 3.436 | 2.905 |
| AD-66111 | ND | ND | ND |
| AD-65403 | 0.511 | 18.036 | 5.013 |

ND—not done

These duplexes were also assayed for in vitro stability using two assays, a tritosome stability assay and a cytosol stability assay, as described above. The results of these assays are provided in Table 22.

TABLE 22

Twenty-four hour tritosome and cytosol stability assays.

| | In vitro metabolic stability % parent remaining at 24 hr incubation | | | |
|---|---|---|---|---|
| | Endo-lysosome | | Cytosol | |
| Duplex ID | % AS | % SS | % AS | % SS |
| AD-65381 | 88 | 72 | 68 | 22 |
| AD-66019 | ND | ND | ND | ND |
| AD-65375 | ND | ND | ND | ND |
| AD-65407 | 100 | 120 | 64 | 24 |
| AD-65377 | 99 | 127 | 80 | 67 |
| AD-65409 | 105 | 120 | 86 | 74 |
| AD-66111 | ND | ND | ND | ND |
| AD-65403 | ND | ND | ND | ND |
| AD-65427 | 115 | 80 | 89 | 66 |
| AD-66110 | ND | ND | ND | ND |
| AD-65421 | ND | ND | ND | ND |

Dose response screens of various combinations of these duplexes were also performed in HepG2.215 cells. The doses of the duplexes used for these assays were 50 nM, 8.333333333 nM, 1.388888889 nM, 0.231481481 nM, 0.038580247 nM, 0.006430041 nM, 0.001071674 nM, 0.000178612 nM, $2.97687 \times 10^{-5}$ nM, $4.96145 \times 10^{-6}$ nM, $8.26909 \times 10^{-7}$ nM, and $1.37818E \times 10^{-7}$ nM, which represent a 1 to 6 dilution of the duplexes starting at 50 nM over 12 doses. At seventy-two hours after transfection of these duplexes, the level of viral RNA (P ORF and S ORF) and the level of secreted HBsAg were determined, as described above. The results of these assays are provided in Table 23.

TABLE 23

Seventy-two hour HBV single dose screen In HepG2.2.15 cells

| DuplexID | S-ORF2 IC50_A (nM) | S-ORF2 IC50_B (nM) | S-ORF2 IC50_Combine (nM) | P-ORF1 IC50_A (nM) | P-ORF1 IC50_B (nM) | P-ORF1 IC50_Combine (nM) | S Ag ELISA ED50 (nM) |
|---|---|---|---|---|---|---|---|
| AD-66019/AD-66110 | 0.0091 | 0.0017 | 0.0038 | 0.0213 | 0.002 | 0.0076 | 0.007482 |
| AD-66019/AD-65421 | 0.0438 | 0.2371 | 0.0131 | 0.0367 | 0.0106 | 0.0204 | 0.026398 |
| AD-65375/AD-66110 | 0.0832 | 1.0896 | 0.193 | 0.0377 | 0.2348 | 0.2022 | 0.004174 |
| AD-65375/AD-65421 | 0.084 | 0.0475 | 0.0708 | 0.0566 | 0.0388 | 0.0371 | 0.030822 |
| AD-65407/AD-66110 | 0.0387 | 0.001 | 0.0083 | 0.0402 | 0.0018 | 0.0116 | 0.010172 |
| AD-65407/AD-65421 | 0.0686 | 0.0062 | 0.0225 | 0.0711 | 0.0177 | 0.0396 | 0.066556 |
| AD-65377/AD-66110 | 0.0634 | 0.8267 | 0.6269 | 0.0477 | 0.073 | 0.0618 | 0.01435 |
| AD-65377/AD-65421 | 0.1461 | 0.0468 | 0.1372 | 0.1207 | 0.0088 | 0.0451 | 0.03419 |
| AD-66111/AD-66110 | 0.0382 | 0.0094 | 0.0161 | 0.0292 | 0.0027 | 0.0088 | 0.013155 |
| AD-66111/AD-65421 | 0.1628 | 0.0919 | 0.1579 | 0.1297 | 0.0396 | 0.0722 | 0.026889 |
| AD-65403/AD-66110 | 0.0499 | 0.0094 | 0.0444 | 0.0383 | 0.0164 | 0.0348 | 0.003783 |
| AD-65403/AD-65421 | 0.1011 | 0.0007 | 0.0208 | 0.1118 | 0.0031 | 0.0297 | 0.014569 |

Example 6. Synthesis and In Vitro Screening of Additional siRNA Duplexes Targeting HBV Additional iRNA molecules targeting the X ORF of the HBV genome were designed and synthesized as described above. A detailed list of the additional unmodified HBV sense and antisense strand sequences is shown in Table 24. A detailed list of the additional modified HBV sense and antisense strand sequences is shown in Table 25.

TABLE 24

Unmodified Sense and Antisense Strand Sequences of HBV dsRNAs

| Duplex ID | Sense OligoName | Sence Sequence (5' to 3') | SEQ ID NO: | Antisense OligoName | Antisense Sequence (5' to 3') | SEQ ID NO: |
|---|---|---|---|---|---|---|
| AD-65776 | A-131859.1 | UGUGCACUUCGCUUCACCUCU | 1607 | A-131860.1 | AGAGGUGAAGCGAAGUGCACACG | 1653 |
| AD-65782 | A-131877.1 | UGCACUUCGCUUCACCUCUGA | 1608 | A-131878.1 | UCAGAGGUGAAGCGAAGUGCACA | 1654 |
| AD-65792 | A-131865.1 | GUGUGCACUUCGCUUCACCUA | 1609 | A-131866.1 | UAGGUGAAGCGAAGUGCACACGG | 1655 |
| AD-65781 | A-131861.1 | CGUGUGCACUUCGCUUCACCU | 1610 | A-131862.1 | AGGUGAAGCGAAGUGCACACGGU | 1656 |
| AD-64304 | A-128443.6 | GUGCACUUCGCUUCACCUCUA | 1611 | A-128444.5 | UAGAGGUGAAGCGAAGUGCACAC | 1657 |
| AD-65771 | A-131857.1 | CCGUGUGCACUUCGCUUCACA | 1612 | A-131858.1 | UGUGAAGCGAAGUGCACACGGUC | 1658 |
| AD-65758 | A-131867.1 | CACUUCGCUUCACCUCUGCAA | 1613 | A-131868.1 | UUGCAGAGGUGAAGCGAAGUGCA | 1659 |
| AD-65777 | A-131875.1 | ACUUCGCUUCACCUCUGCACA | 1614 | A-131876.1 | UGUGCAGAGGUGAAGCGAAGUGC | 1660 |
| AD-61567 | A-123525.2 | GGCUGUAGGCAUAAAUUGGUA | 1615 | A-123526.2 | UACCAAUUUAUGCCUACAGCCUC | 1661 |
| AD-65772 | A-131873.1 | UUCGCUUCACCUCUGCACGUA | 1616 | A-131874.1 | UACGUGCAGAGGUGAAGCGAAGU | 1662 |
| AD-65767 | A-131871.1 | UCGCUUCACCUCUGCACGUCA | 1617 | A-131872.1 | UGACGUGCAGAGGUGAAGCGAAG | 1663 |
| AD-65763 | A-131869.1 | CUUCGCUUCACCUCUGCACGU | 1618 | A-131870.1 | ACGUGCAGAGGUGAAGCGAAGUG | 1664 |
| AD-64281 | A-128395.3 | CCCCGUCUGUGCCUUCUCAUA | 1619 | A-128396.2 | UAUGAGAAGGCACAGACGGGGAG | 1665 |
| AD-64311 | A-128391.3 | CCGUCUGUGCCUUCUCAUCUA | 1620 | A-128392.2 | UAGAUGAGAAGGCACAGACGGGG | 1666 |
| AD-65790 | A-131837.1 | CCAGCACCAUGCAACUUUUUA | 1621 | A-131838.1 | UAAAAAGUUGCAUGGUGCUGGUG | 1667 |
| AD-65761 | A-131841.1 | CACCAGCACCAUGCAACUUUU | 1622 | A-131842.1 | AAAAGUUGCAUGGUGCUGGUGCG | 1668 |
| AD-65786 | A-131849.1 | CACCAUGCAACUUUUUCACCU | 1623 | A-131850.1 | AGGUGAAAAAGUUGCAUGGUGCU | 1669 |
| AD-65785 | A-131835.1 | CAAUGUCAACGACCGACCUUA | 1624 | A-131836.1 | UAAGGUCGGUCGUUGACAUUGCA | 1670 |
| AD-65787 | A-131863.1 | CGCUUCACCUCUGCACGUCGA | 1625 | A-131864.1 | UCGACGUGCAGAGGUGAAGCGAA | 1671 |
| AD-65770 | A-131845.1 | ACCUUGAGGCAUACUUCAAAG | 1626 | A-131846.1 | CUUUGAAGUAUGCCUCAAGGUCG | 1672 |
| AD-65766 | A-131843.1 | CCGACCUUGAGGCAUACUUCA | 1627 | A-131844.1 | UGAAGUAUGCCUCAAGGUCGGUC | 1673 |
| AD-61555 | A-123521.2 | GACCUUGAGGCAUACUUCAAA | 1628 | A-123522.2 | UUUGAAGUAUGCCUCAAGGUCGG | 1674 |
| AD-65762 | A-131855.1 | ACCGACCUUGAGGCAUACUUA | 1629 | A-131856.1 | UAAGUAUGCCUCAAGGUCGGUCG | 1675 |
| AD-65755 | A-131827.1 | UCGCAUGGAGACCACCGUGAA | 1630 | A-131828.1 | UUCACGGUGGUCUCCAUGCGACG | 1676 |
| AD-65788 | A-131811.1 | UUACAUAAGAGGACUCUUGGA | 1631 | A-131812.1 | UCCAAGAGUCCUCUUAUGUAAGA | 1677 |
| AD-65768 | A-131803.1 | UCUUACAUAAGAGGACUCUUA | 1632 | A-131804.1 | UAAGAGUCCUCUUAUGUAAGACC | 1678 |
| AD-61561 | A-123523.2 | ACUUCAAAGACUGUUUGUUUA | 1633 | A-123524.2 | UAAACAAACAGUCUUUGAAGUAU | 1679 |
| AD-65764 | A-131801.1 | UACUUCAAAGACUGUUUGUUU | 1634 | A-131802.1 | AAACAAACAGUCUUUGAAGUAUG | 1680 |
| AD-65753 | A-131799.1 | AUACUUCAAAGACUGUUUGUU | 1635 | A-131800.1 | AACAAACAGUCUUUGAAGUAUGC | 1681 |
| AD-65765 | A-131817.1 | UUGUUUAAAGACUGGGAGGAA | 1636 | A-131818.1 | UUCCUCCCAGUCUUUAAACAAAC | 1682 |
| AD-65769 | A-131819.1 | GCAUACUUCAAAGACUGUUUA | 1637 | A-131820.1 | UAAACAGUCUUUGAAGUAUGCCU | 1683 |

TABLE 24-continued

Unmodified Sense and Antisense Strand Sequences of HBV dsRNAs

| Duplex ID | Sense OligoName | Sence Sequence (5' to 3') | SEQ ID NO: | Antisense OligoName | Antisense Sequence (5' to 3') | SEQ ID NO: |
|---|---|---|---|---|---|---|
| AD-65759 | A-131815.1 | CAAAGACUGUUUGUUUAAGAA | 1638 | A-131816.1 | UCUUUAAACAAACAGUCUUUGAA | 1684 |
| AD-65774 | A-131831.1 | AGACUGUUUGUUUAAAGACUA | 1639 | A-131832.1 | UAGUCUUUAAACAAACAGUCUUU | 1685 |
| AD-65778 | A-131807.1 | GUUUGUUUAAAGACUGGGAGA | 1640 | A-131808.1 | UCUCCCAGUCUUUAAACAAACAG | 1686 |
| AD-65773 | A-131805.1 | GGGGGAGGAGAUUAGAUUAAA | 1641 | A-131806.1 | UUUAAUCUAAUCUCCUCCCCCAA | 1687 |
| AD-65789 | A-131825.1 | GGGGAGGAGAUUAGAUUAAAG | 1642 | A-131826.1 | CUUUAAUCUAAUCUCCUCCCCCA | 1688 |
| AD-65783 | A-131809.1 | GUUGGGGGAGGAGAUUAGAUU | 1643 | A-131810.1 | AAUCUAAUCUCCUCCCCCAACUC | 1689 |
| AD-65754 | A-131813.1 | UUGGGGGAGGAGAUUAGAUUA | 1644 | A-131814.1 | UAAUCUAAUCUCCUCCCCCAACU | 1690 |
| AD-65779 | A-131821.1 | GGGAGGAGAUUAGAUUAAGA | 1645 | A-131822.1 | UCUUUAAUCUAAUCUCCUCCCCC | 1691 |
| AD-65791 | A-131851.1 | UUAGAUUAAAGGUCUUUGUAA | 1646 | A-131852.1 | UUACAAAGACCUUUAAUCUAAUC | 1692 |
| AD-65760 | A-131829.1 | UAGAUUAAAGGUCUUUGUACU | 1647 | A-131830.1 | AGUACAAAGACCUUUAAUCUAAU | 1693 |
| AD-65784 | A-131823.1 | AUUAGAUUAAAGGUCUUUGUA | 1648 | A-131824.1 | UACAAAGACCUUUAAUCUAAUCU | 1694 |
| AD-65757 | A-131853.1 | GAGGAGAUUAGAUUAAAGGUA | 1649 | A-131854.1 | UACCUUUAAUCUAAUCUCCUCCC | 1695 |
| AD-65775 | A-131847.1 | GGACUCUUGGACUCUCUGCAA | 1650 | A-131848.1 | UUGCAGAGAGUCCAAGAGUCCUC | 1696 |
| AD-65780 | A-131833.1 | ACUCUUGGACUCUCUGCAAUA | 1651 | A-131834.1 | UAUUGCAGAGAGUCCAAGAGUCC | 1697 |
| AD-65756 | A-131839.1 | AGAUUAAAGGUCUUUGUACUA | 1652 | A-131840.1 | UAGUACAAAGACCUUUAAUCUAA | 1698 |

TABLE 25

Modified Sense and Antisense Strand Sequences of HBV dsRNAs

| Duplex ID | Sense Oligo Name | Sense Sequence (5' to 3') | SEQ ID NO: |
|---|---|---|---|
| AD-65776 | A-131859.1 | UfsgsUfgCfaCfuUfCfGfcUfuCfaCfcUfcUfL96 | 1699 |
| AD-65782 | A-131877.1 | UfsgsCfaCfuUfcGfCfUfuCfaCfcUfcUfgAfL96 | 1700 |
| AD-65792 | A-131865.1 | GfsusGfuGfcAfcUfUfCfgCfuUfcAfcCfuAfL96 | 1701 |
| AD-65781 | A-131861.1 | CfsgsUfgUfgCfaCfUfUfcGfcUfuCfaCfcUfL96 | 1702 |
| AD-64304 | A-128443.6 | GfsusGfcAfcUfuCfGfCfuUfcAfcCfuCfuAfL96 | 1703 |
| AD-65771 | A-131857.1 | CfscsGfuGfuGfcAfCfUfuCfgCfuUfcAfcAfL96 | 1704 |
| AD-65758 | A-131867.1 | CfsasCfuUfcGfcUfUfCfaCfcUfcUfgCfaAfL96 | 1705 |
| AD-65777 | A-131875.1 | AfscsUfuCfgCfuUfCfAfcCfuCfuGfcAfcAfL96 | 1706 |
| AD-61567 | A-123525.2 | GfsgsCfuGfuAfgGfCfAfuAfaAfuUfgGfuAfL96 | 1707 |
| AD-65772 | A-131873.1 | UfsusCfgCfuUfcAfCfCfuCfuGfcAfcGfuAfL96 | 1708 |
| AD-65767 | A-131871.1 | UfscsGfcUfuCfaCfCfUfcUfgCfaCfgUfcAfL96 | 1709 |

TABLE 25-continued

Modified Sense and Antisense Strand Sequences of HBV dsRNAs

| | | | |
|---|---|---|---|
| AD-65763 | A-131869.1 | CfsusUfcGfcUfuCfAfCfcUfcUfgCfaCfgUfL96 | 1710 |
| AD-64281 | A-128395.3 | CfscsCfcGfuCfuGfUfGfcCfuUfcUfcAfuAfL96 | 1711 |
| AD-64311 | A-128391.3 | CfscsGfuCfuGfuGfCfcfuUfcUfcAfuCfuAfL96 | 1712 |
| AD-65790 | A-131837.1 | CfscsAfgCfaCfcAfUfGfcAfaCfuUfuUfuAfL96 | 1713 |
| AD-65761 | A-131841.1 | CfsasCfcAfgCfaCfCfAfuGfcAfaCfuUfuUfL96 | 1714 |
| AD-65786 | A-131849.1 | CfsasCfcAfuGfcAfAfCfuUfuUfuCfaCfcUfL96 | 1715 |
| AD-65785 | A-131835.1 | CfsasAfuGfuCfaAfCfGfaCfcGfaCfcUfuAfL96 | 1716 |
| AD-65787 | A-131863.1 | CfsgsCfuUfcAfcCfUfCfuGfcAfcGfuCfgAfL96 | 1717 |
| AD-65770 | A-131845.1 | AfscsCfuUfgAfgGfCfAfuAfcUfuCfaAfaGfL96 | 1718 |
| AD-65766 | A-131843.1 | CfscsGfaCfcUfuGfAfGfgCfaUfaCfuUfcAfL96 | 1719 |
| AD-61555 | A-123521.2 | GfsasCfcUfuGfaGfGfCfaUfaCfuUfcAfaAfL96 | 1720 |
| AD-65762 | A-131855.1 | AfscsCfgAfcCfuUfGfaGfGfcAfuAfcUfuAfL96 | 1721 |
| AD-65755 | A-131827.1 | UfscsGfcAfuGfgAfGfAfcCfaCfcGfuGfaAfL96 | 1722 |
| AD-65788 | A-131811.1 | UfsusAfcAfuAfaGfAfGfgAfcUfcUfuGfgAfL96 | 1723 |
| AD-65768 | A-131803.1 | UfscsUfuAfcAfuAfAfGfaGfgAfcUfcUfuAfL96 | 1724 |
| AD-61561 | A-123523.2 | AfscsUfuCfaAfaGfAfCfuGfuUfuGfuUfuAfL96 | 1725 |
| AD-65764 | A-131801.1 | UfsasCfuUfcAfaAfGfAfcUfgUfuUfgUfuUfL96 | 1726 |
| AD-65753 | A-131799.1 | AfsusAfcUfuCfaAfAfGfaCfuGfuUfuGfuUfL96 | 1727 |
| AD-65765 | A-131817.1 | UfsusGfuUfuAfaAfGfAfcUfgGfgAfgGfaAfL96 | 1728 |
| AD-65769 | A-131819.1 | GfscsAfuAfcUfcFfAfAfaGfaCfuGfuUfuAfL96 | 1729 |
| AD-65759 | A-131815.1 | CfsasAfaGfaCfuGfUfUfuGfuUfuAfaAfgAfL96 | 1730 |
| AD-65774 | A-131831.1 | AfsgsAfcUfgUfuUfGfUfuUfaAfaGfaCfuAfL96 | 1731 |
| AD-65778 | A-131807.1 | GfsusUfuGfuUfuAfAfAfgAfcUfgGfgAfgAfL96 | 1732 |
| AD-65773 | A-131805.1 | GfsgsGfgGfaGfgAfGfAfuUfaGfaUfaAfaAfL96 | 1733 |
| AD-65789 | A-131825.1 | GfsgsGfgAfgGfaGfAfUfuAfgAfuUfaAfaGfL96 | 1734 |
| AD-65783 | A-131809.1 | GfsusUfgGfgGfgAfGfGfaGfaUfuAfgAfuUfL96 | 1735 |

TABLE 25-continued

Modified Sense and Antisense Strand Sequences of HBV dsRNAs

| | | | |
|---|---|---|---|
| AD-65754 | A-131813.1 | UfsusGfgGfgGfaGfGfAfgAfuUfaGfaUfuAfL96 | 1736 |
| AD-65779 | A-131821.1 | GfsgsGfaGfgAfgAfUfUfaGfaUfuAfaAfgAfL96 | 1737 |
| AD-65791 | A-131851.1 | UfsusAfgAfuUfaAfAfGfgUfcUfuUfgUfaAfL96 | 1738 |
| AD-65760 | A-131829.1 | UfsasGfaUfuAfaAfGfGfuCfuUfuGfuAfcUfL96 | 1739 |
| AD-65784 | A-131823.1 | AfsusUfaGfaUfuAfAfAfgGfuCfuUfuGfuAfL96 | 1740 |
| AD-65757 | A-131853.1 | GfsasGfgAfgAfuUfAfGfaUfuAfaAfgGfuAfL96 | 1741 |
| AD-65775 | A-131847.1 | GfsgsAfcUfcUfuGfGfAfcUfcUfcUfgCfaAfL96 | 1742 |
| AD-65780 | A-131833.1 | AfscsUfcUfuGfgAfCfUfcUfcUfgCfaAfuAfL96 | 1743 |
| AD-65756 | A-131839.1 | AfsgsAfuUfaAfaGfGfUfcUfuUfgUfaCfuAfL96 | 1744 |

| Duplex ID | Antisense OligoName | Antisense Sequence (5' to 3') | SEQ ID NO: |
|---|---|---|---|
| AD-65776 | A-131860.1 | asGfsaGfgUfgAfaGfcgaAfgUfgCfaCfascsg | 1745 |
| AD-65782 | A-131878.1 | usCfsaGfaGfgUfgAfagcGfaAfgUfgCfascsa | 1746 |
| AD-65792 | A-131866.1 | usAfsgGfuGfaAfgCfgaaGfuGfcAfcAfcsgsg | 1747 |
| AD-65781 | A-131862.1 | asGfsgUfgAfaGfcGfaagUfgCfaCfaCfgsgsu | 1748 |
| AD-64304 | A-128444.5 | usAfsgAfgGfuGfaAfgcgAfaGfuGfcAfcsasc | 1749 |
| AD-65771 | A-131858.1 | usGfsuGfaAfgCfgAfaguGfcAfcAfcGfgsusc | 1750 |
| AD-65758 | A-131868.1 | usUfsgCfaGfaGfgUfgaaGfcGfaAfgUfgscsa | 1751 |
| AD-65777 | A-131876.1 | usGfsuGfcAfgAfgGfugaAfgCfgAfaGfusgsc | 1752 |
| AD-61567 | A-123526.2 | usAfscCfaAfuUfuAfugcCfuAfcAfgCfcsusc | 1753 |
| AD-65772 | A-131874.1 | usAfscGfuGfcAfgAfgguGfaAfgCfgAfasgsu | 1754 |
| AD-65767 | A-131872.1 | usGfsaCfgUfgCfaGfaggUfgAfaGfcGfasasg | 1755 |
| AD-65763 | A-131870.1 | asCfsgUfgCfaGfaGfgugAfaGfcGfaAfgsusg | 1756 |
| AD-64281 | A-128396.2 | usAfsuGfaGfaAfgGfcacAfgAfcGfgGfgsasg | 1757 |
| AD-64311 | A-128392.2 | usAfsgAfuGfaGfaAfggcAfcAfgAfcGfgsgsg | 1758 |
| AD-65790 | A-131838.1 | usAfsaAfaAfgUfuGfcauGfuGfcUfuGfgsusg | 1759 |
| AD-65761 | A-131842.1 | asAfsaAfgUfuGfcAfuggUfgCfuUfgGfugscsg | 1760 |

TABLE 25-continued

Modified Sense and Antisense Strand Sequences of HBV dsRNAs

| | | | |
|---|---|---|---|
| AD-65786 | A-131850.1 | asGfsgUfgAfaAfaAfguuGfcAfuGfgUfgscsu | 1761 |
| AD-65785 | A-131836.1 | usAfsaGfgUfcGfgUfcguUfgAfcAfuUfgscsa | 1762 |
| AD-65787 | A-131864.1 | usCfsgAfcGfuGfcAfgagGfuGfaAfgCfgsasa | 1763 |
| AD-65770 | A-131846.1 | csUfsuUfgAfaGfuAfugcCfuCfaAfgGfuscsg | 1764 |
| AD-65766 | A-131844.1 | usGfsaAfgUfaUfgCfcucAfaGfgUfcGfgsusc | 1765 |
| AD-61555 | A-123522.2 | usUfsuGfaAfgUfaUfgccUfcAfaGfgUfcsgsg | 1766 |
| AD-65762 | A-131856.1 | usAfsaGfuAfuGfcCfucaAfgGfuCfgGfuscsg | 1767 |
| AD-65755 | A-131828.1 | usUfscAfcGfgUfgGfucuCfcAfuGfcGfascsg | 1768 |
| AD-65788 | A-131812.1 | usCfscAfaGfaGfuCfcucUfuAfuGfuAfasgsa | 1769 |
| AD-65768 | A-131804.1 | usAfsaGfaGfuCfcUfcuuAfuGfuAfaGfascsc | 1770 |
| AD-61561 | A-123524.2 | usAfsaAfcAfaAfcAfgucUfuUfgAfaGfusasu | 1771 |
| AD-65764 | A-131802.1 | asAfsaCfaAfaCfaGfucuUfuGfaAfgUfasusg | 1772 |
| AD-65753 | A-131800.1 | asAfscAfaAfcAfgUfcuuUfgAfaGfuAfusgsc | 1773 |
| AD-65765 | A-131818.1 | usUfscCfuCfcCfaGfucuUfuAfaAfcAfasasc | 1774 |
| AD-65769 | A-131820.1 | usAfsaAfcAfgUfcUfuugAfaGfuAfuGfcscsu | 1775 |
| AD-65759 | A-131816.1 | usCfsuUfuAfaAfcAfaacAfgUfcUfuUfgsasa | 1776 |
| AD-65774 | A-131832.1 | usAfsgUfcUfuUfaAfacaAfaCfaGfuCfususu | 1777 |
| AD-65778 | A-131808.1 | usCfsuCfcCfaGfuCfuuuAfaAfcAfaAfcsasg | 1778 |
| AD-65773 | A-131806.1 | usUfsuAfaUfcUfaAfucuCfcUfcCfcCfcsasa | 1779 |
| AD-65789 | A-131826.1 | csUfsuUfaAfuCfuAfaucUfcCfuCfcCfcscsa | 1780 |
| AD-65783 | A-131810.1 | asAfsuCfuAfaUfcUfccuCfcCfcCfaAfcsusc | 1781 |
| AD-65754 | A-131814.1 | usAfsaUfcUfaAfuCfuccUfcCfcCfcAfascsu | 1782 |
| AD-65779 | A-131822.1 | usCfsuUfuAfaUfcUfaauCfuCfcUfcCfcscsc | 1783 |
| AD-65791 | A-131852.1 | usUfsaCfaAfaGfaCfcuuUfaAfuCfuAfasusc | 1784 |
| AD-65760 | A-131830.1 | asGfsuAfcAfaAfgAfccuUfuAfaUfcUfasasu | 1785 |
| AD-65784 | A-131824.1 | usAfscAfaAfgAfcCfuuuAfaUfcUfaAfuscsu | 1786 |

TABLE 25-continued

Modified Sense and Antisense Strand Sequences of HBV dsRNAs

| AD-65757 | A-131854.1 | usAfscCfuUfuAfaUfcuaAfuCfuCfcUfcscsc | 1787 |
| AD-65775 | A-131848.1 | usUfsgCfaGfaGfaGfuccAfaGfaGfuCfcsusc | 1788 |
| AD-65780 | A-131834.1 | usAfsuUfgCfaGfaGfaguCfcAfaGfaGfuscsc | 1789 |
| AD-65756 | A-131840.1 | usAfsgUfaCfaAfaGfaccUfuUfaAfuCfusasa | 1790 |

A single dose screen of these duplexes was performed in Cos7 cells at 1 nm and 50 nm using the Dual-Glo® Luciferase assay described above. The results of the assays are provided in Table 26.

TABLE 26

HBV single dose screen using Dual-Glo Luciferase ® Assay

| Duplex ID | 50 nM | STDEV | 1 nM | STDEV |
| --- | --- | --- | --- | --- |
| AD-65776 | 20.11 | 4.21 | 40.79 | 1.89 |
| AD-65782 | 26.31 | 3.10 | 61.07 | 9.16 |
| AD-65792 | 43.31 | 5.24 | 61.09 | 6.02 |
| AD-65781 | 25.77 | 3.66 | 39.63 | 2.87 |
| AD-64304 | 18.87 | 1.26 | 29.72 | 3.37 |
| AD-65771 | 17.16 | 1.78 | 37.55 | 2.20 |
| AD-65758 | 31.74 | 8.26 | 65.77 | 11.05 |
| AD-65777 | 59.76 | 11.15 | 77.63 | 5.14 |
| AD-61567 | 17.69 | 5.29 | 26.45 | 5.66 |
| AD-65772 | 58.07 | 9.67 | 75.66 | 4.92 |
| AD-65767 | 29.65 | 1.60 | 39.64 | 4.36 |
| AD-65763 | 25.10 | 5.77 | 47.78 | 9.99 |
| AD-64281 | 39.07 | 6.80 | 51.46 | 4.19 |
| AD-64311 | 20.51 | 1.96 | 37.80 | 3.53 |
| AD-65790 | 50.41 | 7.00 | 70.30 | 1.95 |
| AD-65761 | 13.30 | 4.38 | 21.14 | 3.49 |
| AD-65786 | 12.45 | 3.51 | 22.62 | 0.33 |
| AD-65785 | 36.87 | 6.04 | 51.49 | 4.18 |
| AD-65787 | 27.97 | 5.73 | 48.18 | 7.65 |
| AD-65770 | 22.67 | 5.39 | 41.48 | 8.52 |
| AD-65766 | 31.44 | 3.35 | 50.25 | 0.45 |
| AD-61555 | 18.43 | 10.83 | 22.61 | 0.57 |
| AD-65762 | 18.87 | 4.86 | 34.94 | 4.81 |
| AD-65755 | 47.03 | 9.38 | 83.19 | 9.68 |
| AD-65788 | 35.85 | 10.13 | 58.07 | 4.78 |
| AD-65768 | 24.02 | 2.49 | 28.55 | 2.53 |
| AD-61561 | 8.11 | 1.29 | 14.26 | 2.27 |
| AD-65764 | 16.89 | 3.99 | 29.10 | 1.03 |
| AD-65753 | 19.10 | 2.87 | 29.79 | 5.26 |
| AD-65765 | 55.40 | 10.72 | 76.93 | 8.79 |
| AD-65769 | 19.24 | 4.47 | 23.18 | 2.54 |
| AD-65759 | 48.86 | 4.81 | 87.31 | 13.75 |
| AD-65774 | 102.27 | 12.33 | 100.79 | 3.24 |
| AD-65778 | 64.39 | 2.60 | 80.67 | 2.59 |
| AD-65773 | 72.64 | 7.87 | 80.80 | 4.83 |
| AD-65789 | 73.59 | 4.35 | 94.72 | 3.32 |
| AD-65783 | 54.41 | 7.15 | 84.46 | 4.32 |
| AD-65754 | 62.51 | 4.12 | 102.63 | 21.42 |
| AD-65779 | 47.40 | 7.51 | 76.20 | 2.05 |
| AD-65791 | 12.09 | 0.70 | 19.19 | 3.46 |

TABLE 26-continued

HBV single dose screen using Dual-Glo Luciferase ® Assay

| Duplex ID | 50 nM | STDEV | 1 nM | STDEV |
| --- | --- | --- | --- | --- |
| AD-65760 | 13.50 | 4.84 | 25.37 | 2.09 |
| AD-65784 | 19.84 | 1.27 | 31.04 | 3.49 |
| AD-65757 | 22.66 | 3.97 | 24.50 | 5.81 |
| AD-65775 | 47.78 | 3.30 | 58.81 | 3.05 |
| AD-65780 | 29.10 | 2.87 | 42.85 | 2.73 |
| AD-65756 | 10.49 | 1.62 | 19.95 | 2.58 |

Based on these assays, RNAi agents targeting five sites in the HBV X ORF (nucleotides 1551, 1577, 1580, 1806, and 1812 of GenBank Accession No. NC_003977.1) were selected for lead optimization and additional agents were designed and synthesized. These additional agents are evaluated in in vitro assays as described above. A detailed list of the additional unmodified sense and antisense strand sequences targeting the HBV X ORF is shown in Table 27. A detailed list of the additional modified sense and antisense strand sequences targeting the HBV X ORF is shown in Table 28.

These iRNA agents were also assessed for in vivo efficacy using an AAV-HBV mouse model (see, e.g., Yang, et al. (2014) *Cell and Mol Immunol* 11:71). This mouse model exhibits sustained HBV viremia after infection with a recombinant adeno-associated virus (AAV) carrying a replicable HBV genome. Liver expression of the HBV gene in these mice mimics HBV infection in humans and these mice exhibit significant liver inflammation and liver damage, manifested by increased ALT levels, fibrosis and steatosis.

These AAV-HBV mice were subcutaneously administered a single 3 mg/kg dose of AD-66808, AD-66809, AD-66810, AD-66811, AD-66812, AD-66813, AD-66814, AD-66815, AD-66816, and AD-66817 and the level of HBsAg was determined in the serum of the animals pre-dose, and at day 14/15 post-dose. The results of these experiments are provided in Table 29 and demonstrate that serum levels of HBsAg are decrease following a single administration of these agents. Table 29 also provides the results of a single dose screen in Cos7 cells transfected with the indicated HBV iRNAs using the Dual-Glo® Luciferase assay, as described above, for the same RNAi agents. Data are expressed as percent of mRNA remaining relative to negative control at 24 hours.

TABLE 27

Unmodified HBV X ORF Sense and Antisense Sequences.

| DuplexID | SenseSequence (5' to 3') | SEQ ID NO: | Antisense Sequence (5' to 3') | SEQ ID NO: |
|---|---|---|---|---|
| AD-66808 | GUCUGUGCCUUCUCAUCUA | 1791 | UAGAUGAGAAGGCACAGACUU | 1801 |
| AD-66809 | GUCUGUGCCUUCUCAUCUA | 1792 | UAGAUGAGAAGGCACAGACUU | 1802 |
| AD-66810 | GUGUGCACUUCGCUUCACA | 1793 | UGUGAAGCGAAGUGCACACUU | 1803 |
| AD-66811 | GUGUGCACUUCGCUUCACA | 1794 | UGUGAAGCGAAGUGCACACUU | 1804 |
| AD-66812 | UGUGCACUUCGCUUCACCUCU | 1795 | AGAGGUGAAGCGAAGUGCACAUU | 1805 |
| AD-66813 | UGUGCACUUCGCUUCACCUCU | 1796 | AGAGGUGAAGCGAAGUGCACAUU | 1806 |
| AD-66814 | CACCAGCACCAUGCAACUUUU | 1797 | AAAAGUUGCAUGGUGCUGGUGUU | 1807 |
| AD-66815 | CACCAGCACCAUGCAACUUUU | 1798 | AAAAGUUGCAUGGUGCUGGUGUU | 1808 |
| AD-66816 | CACCAUGCAACUUUUUCACCU | 1799 | AGGUGAAAAGUUGCAUGGUGUU | 1809 |
| AD-66817 | CACCAUGCAACUUUUUCACCU | 1800 | AGGUGAAAAGUUGCAUGGUGUU | 1810 |

TABLE 28

Modified HBV X ORF Sense and Antisense Sequences.

| DuplexID | Sense Sequence (5' to 3') | SEQ ID NO: | Antisense Sequence (5' to 3') | SEQ ID NO: |
|---|---|---|---|---|
| AD-66808 | gsuscuGfuGfCfCfuucucaucuaL96 | 1811 | usAfsgauGfaGfAfaggcAfcAfgacsusu | 1821 |
| AD-66809 | gsuscuGfuGfCfCfuucucaucuaL96 | 1812 | UfsAfsgauGfaGfAfaggcAfcAfgacsusu | 1822 |
| AD-66810 | gsusguGfcAfCfUfucgcuucacaL96 | 1813 | usGfsugaAfgCfGfaaguGfcAfcacsusu | 1823 |
| AD-66811 | gsusguGfcAfCfUfucgcuucacaL96 | 1814 | UfsGfsugaAfgCfGfaaguGfcAfcacsusu | 1824 |
| AD-66812 | usgsugcaCfuUfCfGfcuucaccucuL96 | 1815 | asGfsaggUfgAfAfgcgaAfgUfgcacasusu | 1825 |
| AD-66813 | usgsugcaCfuUfCfGfcuucaccucuL96 | 1816 | AfsGfsaggUfgAfAfgcgaAfgUfgcacasusu | 1826 |
| AD-66814 | csasccagCfaCfCfAfugcaacuuuuL96 | 1817 | asAfsaagUfuGfCfauggUfgCfuggugsusu | 1827 |
| AD-66815 | csasccagCfaCfCfAfugcaacuuuuL96 | 1818 | AfsAfsaagUfuGfCfauggUfgCfuggugsusu | 1828 |
| AD-66816 | csasccauGfcAfAfCfuuuuucaccuL96 | 1819 | asGfsgugAfaAfAfaguuGfcAfuggugsusu | 1829 |
| AD-66817 | csasccauGfcAfAfCfuuuuucaccuL96 | 1820 | AfsGfsgugAfaAfAfaguuGfcAfuggugsusu | 1830 |

TABLE 29

| Site (# vRNA[1]) | Duplex ID | In vitro IC$_{50}$ Luc HBV (nM) | Log$_{10}$ HBsAg KD In Vivo @3 mg/kg |
|---|---|---|---|
| 1551 (4) | AD-66808 | 0.187 | 2.4 |
| | AD-66809 | 0.014 | 1.46 |
| 1577 (4) | AD-66810 | 0.290 | 1.7 |
| | AD-66811 | 0.029 | 1.3 |
| 1580 (4) | AD-66812 | 0.795 | 2.19 |
| | AD-66813 | 0.074 | >>1.14 |
| 1806 (4) | AD-66814 | 0.0002 | 1.5 |
| | AD-66815 | 0.0001 | >>1.56 |
| 1812 (4) | AD-66816 | 0.047 | 1.61 |
| | AD-66817 | 0.0001 | 1.60 |

[1]Number of viral RNAs silenced

Example 6. In Vivo Screening of iRNA Duplexes

A subset of lead iRNA agents was assessed for in vivo efficacy using the AAV-HBV mouse model described above. AAV-HBV mice were administered a single 3 mg/kg dose of AD-66019, AD-65375, AD-65047, AD-65377, AD-66111, AD-65421, or AD-66110 and the level of HBsAg was determined in the serum of the animals pre-dose, and at days 5 and 10 post-dose. As a control, AAV-HBV mice were administered a 3 mg/kg dose of a dsRNA targeting mouse/rat transtherytin (mrTTR). The results of these experiments demonstrate that serum levels of HBsAg are decreased following a single administration of these agents.

The percent of pre-dose HBsAg remaining at days 5 and 10 was determined in these animals following administration of a single 3 mg/kg dose. A significant decrease in HBsA at both days 5 and 10 after administration were observed in at least AD-65375, AD-65403, AD-65407, AD-65421, AD-66019, and AD-66111.

Based, at least in part, on the results of the in vitro and in vivo assays described above, AD-65403, which silences 3 HBV RNAs, and AD-66810, which silences the X gene, were selected for further analysis for use in a monotherapy or in a combination therapy of HBV.

In the AAV-HBV mouse model of HBV infection, a single 3 mg/kg dose of AD-65403 achieved potent and specific knockdown of HBsAg. In particular, a single 3 mg/kg subcutaneous dose of AD-65403 achieved up to a 3.9 $\log_{10}$ reduction in HBsAg levels, with a mean HBsAg reduction of 1.8 $\log_{in}$ 5-10 days after a single dose.

In the AAV-HBV mouse model of HBV infection, a single 0.3 mg/kg, 1 mg/kg, 3 mg/kg, or 9 mg/kg dose of AD-66810 achieved potent and specific knockdown of HBsAg, especially at the higher doses of AD-66810.

In the AAV-HBV mouse model of HBV infection, AD-66810 administered in three weekly 3 mg/kg doses, achieved potent and specific knockdown of HBsAg for a period of greater than 4 months.

Example 7. In Vitro Screening of Additional iRNA Duplexes Targeting HDV

In Vitro Screening:
Cell Culture and Transfections:

Cos7 cells (ATCC, Manassas, Va.) were grown to near confluence at 37° C. in an atmosphere of 5% $CO_2$ in DMEM (ATCC) supplemented with 10% FBS, before being released from the plate by trypsinization. Dual-Glo® Luciferase constructs generated in the psiCHECK2 plasmid containing HDV AY633627 derived sequences (Table 30) were transfected into approximately $4 \times 10^3$ cells using Lipofectamine 2000 (Invitrogen, Carlsbad Calif. cat #11668-019). For each well of a 384 well plate, 0.15 µl of Lipofectamine, 4 ng of vector, and an appropriate amount of one of the modified siRNA agents provided in Table 32 were mixed in 15 µl final volume of Opti-MEM and allowed to complex at room temperature for 15 minutes. Subsequently the mixture was then supplemented with the suspension of cells (35 ul in complete media). Cells were incubated for 48 hours before luciferase was measured.

The unmodified sequences of the agents provided in Table 32 are provided in Table 3, which were synthesized as described above.

Dual-Glo® Luciferase Assay

Firefly (transfection control) and Renilla (fused to HBV target sequence) luciferases were measured using Dual-Glo® Luciferase Assay (Promega, Madison, Wis., # E2980). First, media was removed from cells. Then Firefly luciferase activity was measured by adding a mixture of 10 µl of the complete media and 10 µl of Dual-Glo® Luciferase Reagent per well. The mixture was incubated at room temperature for 10-15 minutes before lunimescense (500 nm) was measured on a Spectramax (Molecular Devices) to detect the Firefly luciferase signal. Renilla luciferase activity was measured by adding 10 µl of room temperature Dual-Glo® Stop & Glo® Reagent to each well and the plates were incubated for 10-15 minutes before luminescence was again measured to determine the Renilla luciferase signal. The Dual-Glo® Stop & Glo® Reagent quenches the firefly luciferase signal and sustained luminescence for the Renilla luciferase reaction. siRNA activity was determined by normalizing the Renilla (HDV) signal to the Firefly (control) signal within each well. The magnitude of siRNA activity was then assessed relative to cells that were transfected with the same vector but were not treated with siRNA (mock). All transfections were done at n=2 or greater. siRNA concentration sufficient to inhibit relative Renilla luciferase expression by 50% ($IC_{50}$) was determined by the method described above at a range of concentrations (40 fM-10 nM).

The results of the single dose screen are provided in Table 33 and the results of the dose response screens are provided in Table 34.

TABLE 30

HDV sequences used in luciferase plasmids

| Vector Name | HDV sequence |
|---|---|
| psiCHECK2-<br>HDV-<br>antigenome | GCGATCGCCTCGAACTTGGGCGGCGAGTCCAGCAGTCTCCTCTTTATCAGAAAAGAGTAAGA<br>GCACTGAGGACTGCCGCCTCTTGTCGAGATGAGCCGGTCCGAGTTGAAGAAGAAGCGCGATG<br>GAAGAGAAGATATTCTCGAGAAGTGGGTGAGTGGAAGAAAGAAAGCGGAGGAACTCGAGAGG<br>GATCTCCGGAAGACAAAGAAGAAGATCAAGAAACTTGAGGTCGAAAATCCCTGGCTGGGAAA<br>CATCAAAGGAATTCTCGGAAAGAAGGACAGGGATGGAGAGGGGGCTCCCCCGGCGAAGAGGG<br>CCCGGACGGACCAGATGGAGATAGACTCCGGGCCTAGGAAGAGGCCTCTCAGGGGAGGATTC<br>ACCGACAGGGAGAGGCAGGATCACCGACGAAGGAAGGCCCTCGAGAACAAGAAGAAGCAGCT<br>AGCCGCGGGAGGGAAGAGCCTGAGCAAGGAGGAGGAAGAGGAACTCGGAAGGTTGACCCGGG<br>AAGACGAGGAAAGGAAAAGAAGAGTAGCCGGCCCGCGGGTTGGGGGTGTGAACCCCCTCGAA<br>GGCGGATCGAGGGGAGCGCCCGGGGGCGGCTTCGTCCCCAGCATGCAAGGAGTCCCGGAGTC<br>CCCCTTCGCTCGGACGGGGGAGGGGCTGGACATAAGAGGAACCCGGGGATTCCCATAGGATA<br>TACTCTTCCCATCCGATCCACCCTTCTCTCCCCAGAGTTGTCGTCCCCAGTGAATAAAGCGG<br>GTTTCCACTCACAGGTTCACCGTCTCGCGTCCTTCTTTCCTCTTCGGGTCGGCATGGCATCT<br>CCACCTCCTCGCGGTCCGACCTGGGCATCCGAAGGAGGACGCACGTCCACTCGGATGGCTAA<br>GGGAGAGCCACTTTTCTCTCGATTCTCTATCGGAATCTAGAGAGATTTGTGGGTCCCATTCG<br>CCATTACCGAGGGGACGGTCCCCTCGGAATGTTGCCCAGCCGGCGCCAGCGAGGAGGCTGGG<br>ACCATGCCGGCCATCAGGTAAGAAAGGATGGAACGCGGACCCTGCAGAGTGGGGTCCCGCCA<br>TTCCTGGGCGACCCTTGGGGGGGGAGTCGGAATCGAGCATCGGGAAGGGCATCCCATGGCTC<br>CACTGGTCCCCGGTGTTCCCAGCACCCCCTCCGGTCACTTTCGAAGGGGGTCCGGGGTCCCG<br>CTAGATGGGGACGATAAGTCGAGTTCCCCGGGATAAGCCTCACTCGTCCCCTCTCGGGGGGC<br>GGAACACCCACCGGCTAGCCCCGTTGCTTTCTTTGCTTTCCTCCTCGCTTCGGTCTCCCCCT<br>ACTCCTAGCATCTCCTCCTATCGCTATGGCCTTACTCCTACCGCTCGAAGCGCCTCTGTTCG<br>CTGAAGGGGTCCTCTGGAGGTGATTTCTCTGCTCATCTCCGAGTGTGTTCCTCCCTCTGGTG<br>TTCTCAACCCTTCGGCCGGAGTGCTCTCCAAACTTGGGCGTCGGGCCTTTCGGATCGGGGGG<br>GCCCCCCCTTCTCTTCCATCTGTCCTCTTTCCCCTTCCGAGATGTCTCCAGCGTTATGGGGA<br>AAGCTTCCGACTCTTGTATTCTCTTTTGGCCTTCTTGGGAGACATCTCCTCGGCGTTCCAAT<br>ACTCTTTACCACTTTACCCCTCTCGGGCACTGATCCTTCCCCCGCGGACTCTTCGCTCGGAA<br>TTGGCCCATGGCGGCCGC (SEQ ID NO: 1835) |
| psiCHECK2-<br>HDV-genome | GCGATCGCCATGGGCCAATTCCGAGCGAAGAGTCCGCGGGGGAAGGATCAGTGCCCGAGAGG<br>GGTAAAGTGGTAAAGAGTATTGGAACGCCGAGGAGATGTCTCCCAAGAAGGCCAAAAGAGAA<br>TACAAGAGTCGGAAGCTTTCCCCATAACGCTGGAGACATCTCGGAAGGGGAAAGAGGACAGA<br>TGGAAGAGAAGGGGGGGCCCCCCCGATCCGAAAGGCCCGACGCCCAAGTTTGGAGAGCACTC |

TABLE 30-continued

HDV sequences used in luciferase plasmids

| Vector Name | HDV sequence |
|---|---|
| | CGGCCGAAGGGTTGAGAACACCAGAGGGAGGAACACACTCGGAGATGAGCAGAGAAATCACC<br>TCCAGAGGACCCCTTCAGCGAACAGAGGCGCTTCGAGCGGTAGGAGTAAGGCCATAGCGATA<br>GGAGGAGATGCTAGGAGTAGGGGGAGACCGAAGCGAGGAGGAAAGCAAAGAAAGCAACGGGG<br>CTAGCCGGTGGGTGTTCCGCCCCCCGAGAGGGGACGAGTGAGGCTTATCCCGGGGAACTCGA<br>CTTATCGTCCCCATCTAGCGGGACCCCGGACCCCCTTCGAAAGTGACCGGAGGGGGTGCTGG<br>GAACACCGGGGACCAGTGGAGCCATGGGATGCCCTTCCCGATGCTCGATTCCGACTCCCCCC<br>CCAAGGGTCGCCCAGGAATGGCGGGACCCCACTCTGCAGGGTCCGCGTTCCATCCTTTCTTA<br>CCTGATGGCCGGCATGGTCCCAGCCTCCTCGCTGGCGCCGGCTGGGCAACATTCCGAGGGGA<br>CCGTCCCCTCGGTAATGGCGAATGGGACCCACAAATCTCTCTAGATTCCGATAGAGAATCGA<br>GAGAAAAGTGGCTCTCCCTTAGCCATCCGAGTGGACGTGCGTCCTCCTTCGGATGCCCAGGT<br>CGGACCGCGAGGAGGTGGAGATGCCATGCCGACCCGAAGAGGAAAGAAGGACGCGAGACGGT<br>GAACCTGTGAGTGGAAACCCGCTTTATTCACTGGGGACGACAACTCTGGGGAGAGAAGGGTG<br>GATCGGATGGGAAGAGTATATCCTATGGGAATCCCGGGTTCCTCTTATGTCCAGCCCCTCC<br>CCCGTCCGAGCGAAGGGGGACTCCGGGACTCCTTGCATGCTGGGGACGAAGCCGCCCCCGGG<br>CGCTCCCCTCGATCCGCCTTCGAGGGGGTTCACACCCCCAACCCGCGGGCCGGCTACTCTTC<br>TTTTCCTTTCCTCGTCTTCCCGGGTCAACCTTCCGAGTTCCTCTTCCTCCTCCTTGCTCAGG<br>CTCTTCCCTCCCGCGGCTAGCTGCTTCTTCTTGTTCTCGAGGGCCTTCCTTCGTCGGTGATC<br>CTGCCTCTCCCTGTCGGTAATCCTCCCCTGAGAGGCCTCTTCCTAGGCCCGGAGTCTATCT<br>CCATCTGGTCCGTCCGGGCCCTCTTCGCCGGGGAGCCCCCTCTCCATCCCTGTCCTTCTTT<br>CCGAGAATTCCTTTGATGTTTCCCAGCCAGGGATTTTCGACCTCAAGTTTCTTGATCTTCTT<br>CTTTGTCTTCCGGAGATCCTCTCGAGTTCCTCCGCTTTCTTTCTTCCACTCACCCACTTCT<br>CGAGAATATCTTCTCTTCCATCGCGCTTCTTCTTCAACTCGGACCGGCTCATCTCGACAAGA<br>GGCGGCAGTCCTCAGTGCTCTTACTCTTTTCTGATAAAGAGGACTGCTGGACTCGCCGCC<br>CAAGTTCGAGGCGGCCGC (SEQ ID NO: 1836) |
| psiCHECK2-<br>HDV-<br>antigenome<br>hot spot | GCGATCGCGAAGACAAAGAAGAAGATCAAGAAACTTGAGGTCGAAAATCCCTGGCTGGGAAA<br>CATCAAAGGAATTCTCGGAAAGAAGGACAGGGATGGCGGCCGC (SEQ ID NO: 1837) |
| psiCHECK2-<br>HDV-genome<br>hot spot | GCGATCGCCATCCCTGTCCTTCTTTCCGAGAATTCCTTTGATGTTTCCCAGCCAGGGATTTT<br>CGACCTCAAGTTTCTTGATCTTCTTCTTTGTCTTCGCGGCCGC (SEQ ID NO: 1838) |

TABLE 31

Unmodified Sense and Antisense Strand Sequences of HDV dsRNAs

| Duple Name | Sense Oligo Name | Senses Sequence (5' to 3') | SEQ ID NO: | Antisense Oligo Name | Antisense Sequence (5' to 3') | SEQ ID NO: |
|---|---|---|---|---|---|---|
| AD-67176.1 | A-134242.1 | UCCCAAGAAGGCCAAAAGAGA | 1839 | A-134243.1 | UCUCUUUUGGCCUUCUUGGGAGA | 2017 |
| AD-67177.1 | A-134244.1 | AGUUUCUUGAUCUUCUUCUUU | 1840 | A-134245.1 | AAAGAAGAAGAUCAAGAAACUUG | 2018 |
| AD-67178.1 | A-134246.1 | UCUUUUCUGAUAAAGAGGAGA | 1841 | A-134247.1 | UCUCCUCUUUAUCAGAAAAGAGU | 2019 |
| AD-67179.1 | A-134248.1 | AGUGGUAAAGAGUAUUGGAAA | 1842 | A-134249.1 | UUUCCAAUACUCUUUACCACUUU | 2020 |
| AD-67180.1 | A-134250.1 | CUCAAGUUUCUUGAUCUUCUU | 1843 | A-134251.1 | AAGAAGAUCAAGAAACUUGAGGU | 2021 |
| AD-67181.1 | A-134252.1 | AAGGCCAAAAGAGAAUACAAA | 1844 | A-134253.1 | UUUGUAUUCUCUUUUGGCCUUCU | 2022 |
| AD-67182.1 | A-134254.1 | GACCUCAAGUUUCUUGAUCUU | 1845 | A-134255.1 | AAGAUCAAGAAACUUGAGGUCGA | 2023 |
| AD-67183.1 | A-134256.1 | AGGCCAAAAGAGAAUACAAGA | 1846 | A-134257.1 | UCUUGUAUUCUCUUUUGGCCUUC | 2024 |
| AD-67184.1 | A-134258.1 | CGAUAGAGAAUCGAGAGAAAA | 1847 | A-134259.1 | UUUUCUCUCGAUUCUCUAUCGGA | 2025 |
| AD-67185.1 | A-134260.1 | GAUAGAGAAUCGAGAGAAAAG | 1848 | A-134261.1 | CUUUUCUCUCGAUUCUCUAUCGG | 2026 |
| AD-67186.1 | A-134262.1 | ACCCACAAAUCUCUCUAGAUU | 1849 | A-134263.1 | AAUCUAGAGAGAUUUGUGGGUCC | 2027 |
| AD-67187.1 | A-134264.1 | GGAUGGGAAGAGUAUAUCCUA | 1850 | A-134265.1 | UAGGAUAUACUCUUCCCAUCCGA | 2028 |
| AD-67188.1 | A-134266.1 | CCGAUAGAGAAUCGAGAGAAA | 1851 | A-134267.1 | UUUCUCUCGAUUCUCUAUCGGAA | 2029 |
| AD-67189.1 | A-134268.1 | UCCGAUAGAGAAUCGAGAGAA | 1852 | A-134269.1 | UUCUCUCGAUUCUCUAUCGGAAU | 2030 |
| AD-67190.1 | A-134270.1 | UGAGUGGAAACCCGCUUUAUU | 1853 | A-134271.1 | AAUAAAGCGGGUUUCCACUCACA | 2031 |
| AD-67191.1 | A-134272.1 | CCUUCUUUCCGAGAAUUCCUU | 1854 | A-134273.1 | AAGGAAUUCUCGGAAAGAAGGAC | 2032 |

TABLE 31-continued

Unmodified Sense and Antisense Strand Sequences of HDV dsRNAs

| Duple Name | Sense Oligo Name | Senses Sequence (5' to 3') | SEQ ID NO: | Antisense Oligo Name | Antisense Sequence (5' to 3') | SEQ ID NO: |
|---|---|---|---|---|---|---|
| AD-67192.1 | A-134274.1 | CUGUGAGUGGAAACCCGCUUU | 1855 | A-134275.1 | AAAGCGGGUUUCCACUCACAGGU | 2033 |
| AD-67193.1 | A-134276.1 | GACCCACAAAUCUCUCUAGAU | 1856 | A-134277.1 | AUCUAGAGAGAUUUGUGGGUCCC | 2034 |
| AD-67194.1 | A-134278.1 | GCUGGGAAACAUCAAAGGAAU | 1857 | A-134279.1 | AUUCCUUUGAUGUUUCCCAGCCA | 2035 |
| AD-67195.1 | A-134280.1 | ACAGUUGGAAGGCUCAAGGAG | 1858 | A-134281.1 | UGUCAACCUUCCGAGUUCCUCUU | 2036 |
| AD-67196.1 | A-134282.1 | AAGGAGGAGGAACGAGUCCGA | 1859 | A-134283.1 | UUCCUCCUCCUUGCUCAGGCUCU | 2037 |
| AD-67197.1 | A-134284.1 | UCUCCUCUUUAUCAGAAAGA | 1860 | A-134285.1 | UCUUUUCUGAUAAAGAGGAGACU | 2038 |
| AD-67198.1 | A-134286.1 | UCCAGCAGUCUCCUCUUUAUA | 1861 | A-134287.1 | UAUAAAGAGGAGACUGCUGGACU | 2039 |
| AD-67199.1 | A-134288.1 | AAAGAAGAAGAUCAAGAAACU | 1862 | A-134289.1 | AGUUUCUUGAUCUUCUUCUUUGU | 2040 |
| AD-67200.1 | A-134290.1 | AAGAAGAAGAUCAAGAAACUU | 1863 | A-134291.1 | AAGUUUCUUGAUCUUCUUCUUUG | 2041 |
| AD-67201.1 | A-134292.1 | GAGGUCGAAAAUCCCUGGCUA | 1864 | A-134293.1 | UAGCCAGGGAUUUUCGACCUCAA | 2042 |
| AD-67202.1 | A-134294.1 | CCCUGGCUGGGAAACAUCAAA | 1865 | A-134295.1 | UUUGAUGUUUCCCAGCCAGGGAU | 2043 |
| AD-67203.1 | A-134296.1 | CUGGCUGGGAAACAUCAAAGA | 1866 | A-134297.1 | UCUUUGAUGUUUCCCAGCCAGGG | 2044 |
| AD-67204.1 | A-134298.1 | UGGCUGGGAAACAUCAAAGGA | 1867 | A-134299.1 | UCCUUUGAUGUUUCCCAGCCAGG | 2045 |
| AD-67205.1 | A-134300.1 | GGCUGGGAAACAUCAAAGGAA | 1868 | A-134301.1 | UUCCUUUGAUGUUUCCCAGCCAG | 2046 |
| AD-67206.1 | A-134302.1 | UCAAAGGAAUUCUCGGAAAGA | 1869 | A-134303.1 | UCUUUCCGAGAAUUCCUUUGAUG | 2047 |
| AD-67207.1 | A-134304.1 | UGGGAAACAUCAAAGGAAUUA | 1870 | A-134305.1 | UAAUUCCUUUGAUGUUUCCCAGC | 2048 |
| AD-67208.1 | A-134306.1 | GGAAACAUCAAAGGAAUUCUA | 1871 | A-134307.1 | UAGAAUUCCUUUGAUGUUUCCCA | 2049 |
| AD-67209.1 | A-134308.1 | GAAACAUCAAAGGAAUUCUCA | 1872 | A-134309.1 | UGAGAAUUCCUUUGAUGUUUCCC | 2050 |
| AD-67210.1 | A-134310.1 | AAACAUCAAAGGAAUUCUCGA | 1873 | A-134311.1 | UCGAGAAUUCCUUUGAUGUUUCC | 2051 |
| AD-67211.1 | A-134312.1 | CAUCAAAGGAAUUCUCGGAAA | 1874 | A-134313.1 | UUUCCGAGAAUUCCUUUGAUGUU | 2052 |
| AD-67212.1 | A-134314.1 | AAAGGAAUUCUCGGAAAGAAA | 1875 | A-134315.1 | UUUCUUUCCGAGAAUUCCUUUGA | 2053 |
| AD-67213.1 | A-134316.1 | AAGGAAUUCUCGGAAAGAAGA | 1876 | A-134317.1 | UCUUCUUUCCGAGAAUUCCUUUG | 2054 |
| AD-67214.1 | A-134320.1 | GGCCCUCGAGAACAAGAAGAA | 1877 | A-134321.1 | UUCUUCUUGUUCUCGAGGGCCUU | 2055 |
| AD-67215.1 | A-134322.1 | GCCCUCGAGAACAAGAAGAAA | 1878 | A-134323.1 | UUUCUUCUUGUUCUCGAGGGCCU | 2056 |
| AD-67216.1 | A-134324.1 | CCCUCGAGAACAAGAAGAAGA | 1879 | A-134325.1 | UCUUCUUCUUGUUCUCGAGGGCC | 2057 |
| AD-67217.1 | A-134326.1 | GGAAAGGAAAAGAAGAGUAGA | 1880 | A-134327.1 | UCUACUCUUCUUUUCCUUUCCUC | 2058 |
| AD-67218.1 | A-134328.1 | AAGGAAAAGAAGAGUAGCCGA | 1881 | A-134329.1 | UCGGCUACUCUUCUUUUCCUUUC | 2059 |
| AD-67219.1 | A-134330.1 | GGGGGUGUGAACCCCCUCGAA | 1882 | A-134331.1 | UUCGAGGGGGUUCACACCCCCAA | 2060 |
| AD-67220.1 | A-134332.1 | GGGUGUGAACCCCCUCGAAGA | 1883 | A-134333.1 | UCUUCGAGGGGGUUCACACCCCC | 2061 |
| AD-67250.1 | A-134346.1 | AGUUUCUUGAUCUUCUUCUUU | 1884 | A-134347.1 | AAAGAAGAAGAUCAAGAAACUUG | 2062 |
| AD-67251.1 | A-134348.1 | UCUUUUCUGAUAAAGAGGAGA | 1885 | A-134349.1 | UCUCCUCUUUAUCAGAAAAGAGU | 2063 |
| AD-67252.1 | A-134350.1 | AGUGGUAAAGAGUAUUGGAAA | 1886 | A-134351.1 | UUUCCAAUACUCUUUACCACUUU | 2064 |
| AD-67253.1 | A-134352.1 | CUCAAGUUUCUUGAUCUUCUU | 1887 | A-134353.1 | AAGAAGAUCAAGAAACUUGAGGU | 2065 |
| AD-67254.1 | A-134354.1 | AAGGCCAAAAGAGAAUACAAA | 1888 | A-134355.1 | UUUGUAUUCUCUUUUGGCCUUCU | 2066 |
| AD-67255.1 | A-134358.1 | AGGCCAAAAGAGAAUACAAGA | 1889 | A-134359.1 | UCUUGUAUUCUCUUUUGGCCUUC | 2067 |
| AD-67256.1 | A-134360.1 | CGAUAGAGAAUCGAGAGAAAA | 1890 | A-134361.1 | UUUUCUCUCGAUUCUCUAUCGGA | 2068 |
| AD-67257.1 | A-134362.1 | GAUAGAGAAUCGAGAGAAAAG | 1891 | A-134363.1 | CUUUUCUCUCGAUUCUCUAUCGG | 2069 |

TABLE 31-continued

Unmodified Sense and Antisense Strand Sequences of HDV dsRNAs

| Duple Name | Sense Oligo Name | Senses Sequence (5' to 3') | SEQ ID NO: | Antisense Oligo Name | Antisense Sequence (5' to 3') | SEQ ID NO: |
|---|---|---|---|---|---|---|
| AD-67258.1 | A-134364.1 | ACCCACAAAUCUCUCUAGAUU | 1892 | A-134365.1 | AAUCUAGAGAGAUUUGUGGGUCC | 2070 |
| AD-67259.1 | A-134366.1 | GGAUGGGAAGAGUAUAUCCUA | 1893 | A-134367.1 | UAGGAUAUACUCUUCCCAUCCGA | 2071 |
| AD-67260.1 | A-134368.1 | CCGAUAGAGAAUCGAGAGAAA | 1894 | A-134369.1 | UUUCUCUCGAUUCUCUAUCGGAA | 2072 |
| AD-67261.1 | A-134370.1 | UCCGAUAGAGAAUCGAGAGAA | 1895 | A-134371.1 | UUCUCUCGAUUCUCUAUCGGAAU | 2073 |
| AD-67262.1 | A-134372.1 | UGAGUGGAAACCCGCUUUAUU | 1896 | A-134373.1 | AAUAAAGCGGGUUUCCACUCACA | 2074 |
| AD-67263.1 | A-134374.1 | CCUUCUUUCCGAGAAUUCCUU | 1897 | A-134375.1 | AAGGAAUUCUCGGAAAGAAGGAC | 2075 |
| AD-67264.1 | A-134376.1 | CUGUGAGUGGAAACCCGCUUU | 1898 | A-134377.1 | AAAGCGGGUUUCCACUCACAGGU | 2076 |
| AD-67265.1 | A-134378.1 | GACCCACAAAUCUCUCUAGAU | 1899 | A-134379.1 | AUCUAGAGAGAUUUGUGGGUCCC | 2077 |
| AD-67266.1 | A-134380.1 | GCUGGGAAACAUCAAAGGAAU | 1900 | A-134381.1 | AUUCCUUUGAUGUUUCCCAGCCA | 2078 |
| AD-67267.1 | A-134382.1 | ACAGUUGGAAGGCUCAAGGAG | 1901 | A-134383.1 | UGUCAACCUUCCGAGUUCCUCUU | 2079 |
| AD-67268.1 | A-134384.1 | AAGGAGGAGGAACGAGUCCGA | 1902 | A-134385.1 | UUCCUCCUCCUUGCUCAGGCUCU | 2080 |
| AD-67269.1 | A-134386.1 | UCUCCUCUUUAUCAGAAAAGA | 1903 | A-134387.1 | UCUUUUCUGAUAAAGAGGAGACU | 2081 |
| AD-67270.1 | A-134388.1 | UCCAGCAGUCUCCUCUUUAUA | 1904 | A-134389.1 | UAUAAAGAGGAGACUGCUGGACU | 2082 |
| AD-67271.1 | A-134390.1 | AAAGAAGAAGAUCAAGAAACU | 1905 | A-134391.1 | AGUUUCUUGAUCUUCUUCUUUGU | 2083 |
| AD-67272.1 | A-134392.1 | AAGAAGAAGAUCAAGAAACUU | 1906 | A-134393.1 | AAGUUUCUUGAUCUUCUUCUUUG | 2084 |
| AD-67273.1 | A-134394.1 | GAGGUCGAAAAUCCCUGGCUA | 1907 | A-134395.1 | UAGCCAGGGAUUUUCGACCUCAA | 2085 |
| AD-67274.1 | A-134396.1 | CCCUGGCUGGGAAACAUCAAA | 1908 | A-134397.1 | UUUGAUGUUUCCCAGCCAGGGAU | 2086 |
| AD-67275.1 | A-134398.1 | CUGGCUGGGAAACAUCAAAGA | 1909 | A-134399.1 | UCUUUGAUGUUUCCCAGCCAGGG | 2087 |
| AD-67276.1 | A-134400.1 | UGGCUGGGAAACAUCAAAGGA | 1910 | A-134401.1 | UCCUUUGAUGUUUCCCAGCCAGG | 2088 |
| AD-67277.1 | A-134402.1 | GGCUGGGAAACAUCAAAGGAA | 1911 | A-134403.1 | UUCCUUUGAUGUUUCCCAGCCAG | 2089 |
| AD-67278.1 | A-134404.1 | UCAAAGGAAUUCUCGGAAAGA | 1912 | A-134405.1 | UCUUUCCGAGAAUUCCUUUGAUG | 2090 |
| AD-67279.1 | A-134406.1 | UGGGAAACAUCAAAGGAAUUA | 1913 | A-134407.1 | UAAUUCCUUUGAUGUUUCCCAGC | 2091 |
| AD-67280.1 | A-134408.1 | GGAAACAUCAAAGGAAUUCUA | 1914 | A-134409.1 | UAGAAUUCCUUUGAUGUUUCCCA | 2092 |
| AD-67281.1 | A-134410.1 | GAAACAUCAAAGGAAUUCUCA | 1915 | A-134411.1 | UGAGAAUUCCUUUGAUGUUUCCC | 2093 |
| AD-67282.1 | A-134414.1 | CAUCAAAGGAAUUCUCGGAAA | 1916 | A-134415.1 | UUUCCGAGAAUUCCUUUGAUGUU | 2094 |
| AD-67283.1 | A-134416.1 | AAAGGAAUUCUCGGAAAGAAA | 1917 | A-134417.1 | UUUCUUUCCGAGAAUUCCUUUGA | 2095 |
| AD-67284.1 | A-134418.1 | AAGGAAUUCUCGGAAAGAAGA | 1918 | A-134419.1 | UCUUCUUUCCGAGAAUUCCUUUG | 2096 |
| AD-67285.1 | A-134420.1 | ACGAAGGAAGGCCCUCGAGAA | 1919 | A-134421.1 | UUCUCGAGGGCCUUCCUUCGUCG | 2097 |
| AD-67286.1 | A-134422.1 | GGCCCUCGAGAACAAGAAGAA | 1920 | A-134423.1 | UUCUUCUUGUUCUCGAGGGCCUU | 2098 |
| AD-67287.1 | A-134424.1 | GCCCUCGAGAACAAGAAGAAA | 1921 | A-134425.1 | UUUCUUCUUGUUCUCGAGGGCCU | 2099 |
| AD-67288.1 | A-134426.1 | CCCUCGAGAACAAGAAGAAGA | 1922 | A-134427.1 | UCUUCUUCUUGUUCUCGAGGGCC | 2100 |
| AD-67289.1 | A-134428.1 | GGAAAGGAAAAGAAGAGUAGA | 1923 | A-134429.1 | UCUACUCUUCUUUUCCUUUCCUC | 2101 |
| AD-67290.1 | A-134430.1 | AAGGAAAAGAAGAGUAGCCGA | 1924 | A-134431.1 | UCGGCUACUCUUCUUUUCCUUUC | 2102 |
| AD-67291.1 | A-134432.1 | GGGGGUGUGAACCCCCUCGAA | 1925 | A-134433.1 | UUCGAGGGGGUUCACACCCCCAA | 2103 |
| AD-67292.1 | A-134434.1 | GGGUGUGAACCCCCUCGAAGA | 1926 | A-134435.1 | UCUUCGAGGGGGUUCACACCCCC | 2104 |
| AD-70224.1 | A-141079.1 | AAACUUGAGGUCGAAAAUA | 1927 | A-141080.1 | UAUUUUCGACCUCAAGUUUU | 2105 |
| AD-70225.1 | A-141081.1 | AAACUUGAGGUCGAAAAUA | 1928 | A-141082.1 | UAUUUUCGACCUCAAGUUUU | 2106 |

TABLE 31-continued

Unmodified Sense and Antisense Strand Sequences of HDV dsRNAs

| Duple Name | Sense Oligo Name | Senses Sequence (5' to 3') | SEQ ID NO: | Antisense Oligo Name | Antisense Sequence (5' to 3') | SEQ ID NO: |
|---|---|---|---|---|---|---|
| AD-70226.1 | A-141083.1 | AAACUUGAGGUCGAAAAUA | 1929 | A-141084.1 | UAUUUUCGACCTCAAGUUUUU | 2107 |
| AD-70227.1 | A-141085.1 | AAACUUGAGGUCGAAAAUA | 1930 | A-141084.1 | UAUUUUCGACCTCAAGUUUUU | 2108 |
| AD-70228.1 | A-141086.1 | AGAAACUUGAGGUCGAAAAUA | 1931 | A-141087.1 | UAUUUUCGACCUCAAGUUUCU | 2109 |
| AD-70229.1 | A-141090.1 | GAUCAAGAAACUUGAGGUA | 1932 | A-141091.1 | UACCUCAAGUUUCUUGAUCUU | 2110 |
| AD-70230.1 | A-141092.1 | GAUCAAGAAACUUGAGGUA | 1933 | A-141093.1 | UACCUCAAGUUUCUUGAUCUU | 2111 |
| AD-70231.1 | A-141094.1 | GAUCAAGAAACUUGAGGUU | 1934 | A-141093.1 | UACCUCAAGUUUCUUGAUCUU | 2112 |
| AD-70232.1 | A-141095.1 | AAGAUCAAGAAACUUGAGGUA | 1935 | A-141096.1 | UACCUCAAGUUUCUUGAUCUU | 2113 |
| AD-70233.1 | A-141097.1 | UCAAGAAACUUGAGGUCGA | 1936 | A-141098.1 | UCGACCUCAAGUUUCUUGAUU | 2114 |
| AD-70234.1 | A-141097.1 | UCAAGAAACUUGAGGUCGA | 1937 | A-141099.1 | UCGACCUCAAGUUUCUUGAUU | 2115 |
| AD-70235.1 | A-141100.1 | UCAAGAAACUUGAGGUCGA | 1938 | A-141101.1 | UCGACCUCAAGUUUCUUGAUU | 2116 |
| AD-70236.1 | A-141102.1 | UCAAGAAACUUGAGGUCGA | 1939 | A-141103.1 | UCGACCUCAAGTUUCUUGAUU | 2117 |
| AD-70237.1 | A-141104.1 | UCAAGAAACUUGAGCUCGA | 1940 | A-141103.1 | UCGACCUCAAGTUUCUUGAUU | 2118 |
| AD-70238.1 | A-141105.1 | UCAAGAAACUUGAGGUCGA | 1941 | A-141106.1 | UCGACCUCAAGUUUCUUGA | 2119 |
| AD-70239.1 | A-141107.1 | AAGAUCAAGAAACUUGAGA | 1942 | A-141108.1 | UCUCAAGUUUCUUGAUCUUUU | 2120 |
| AD-70240.1 | A-141107.1 | AAGAUCAAGAAACUUGAGA | 1943 | A-141109.1 | UCUCAAGUUUCUUGAUCUUUU | 2121 |
| AD-70241.1 | A-141110.1 | AAGAUCAAGAAACUUGAGA | 1944 | A-141111.1 | UCUCAAGUUUCUUGAUCUUUU | 2122 |
| AD-70242.1 | A-141112.1 | AAGAUCAAGAAACUUGAGA | 1945 | A-141113.1 | UCUCAAGUUUCTUGAUCUUUU | 2123 |
| AD-70243.1 | A-141114.1 | AAGAUCAAGAAACUAGAGA | 1946 | A-141113.1 | UCUCAAGUUUCTUGAUCUUUU | 2124 |
| AD-70244.1 | A-141115.1 | AGAAGAUCAAGAAACUUGAGA | 1947 | A-141116.1 | UCUCAAGUUUCUUGAUCUUCU | 2125 |
| AD-70245.1 | A-141117.1 | CAUCAAAGGAAUUCUCGGA | 1948 | A-141118.1 | UCCGAGAAUUCCUUUGAUGUU | 2126 |
| AD-70246.1 | A-141119.1 | CAUCAAAGGAAUUCUCGGA | 1949 | A-141120.1 | UCCGAGAAUUCCUUUGAUGUU | 2127 |
| AD-70247.1 | A-141121.1 | CAUCAAAGGAAUUCUCGGA | 1950 | A-141122.1 | UCCGAGAAUUCCUUUGAUGUU | 2128 |
| AD-70248.1 | A-141123.1 | CAUCAAAGGAAUUCTCGGA | 1951 | A-141122.1 | UCCGAGAAUUCCUUUGAUGUU | 2129 |
| AD-70249.1 | A-141124.1 | AACAUCAAAGGAAUUCUCGGA | 1952 | A-141125.1 | UCCGAGAAUUCCUUUGAUGUU | 2130 |
| AD-70250.1 | A-141126.1 | AUCAAGAAACUUGAGGUCA | 1953 | A-141127.1 | UGACCUCAAGUUUCUUGAUUU | 2131 |
| AD-70251.1 | A-141126.1 | AUCAAGAAACUUGAGGUCA | 1954 | A-141128.1 | UGACCUCAAGUUUCUUGAUUU | 2132 |
| AD-70252.1 | A-141129.1 | AUCAAGAAACUUGAGGUCA | 1955 | A-141130.1 | UGACCUCAAGUUUCUUGAUUU | 2133 |
| AD-70253.1 | A-141131.1 | AUCAAGAAACUUGAGGUCA | 1956 | A-141132.1 | UGACCUCAAGUUCUUGAUUU | 2134 |
| AD-70254.1 | A-141133.1 | AUCAAGAAACUUGACGUCA | 1957 | A-141132.1 | UGACCUCAAGUUCUUGAUUU | 2135 |
| AD-70255.1 | A-141134.1 | AGAUCAAGAAACUUGAGGUCA | 1958 | A-141135.1 | UGACCUCAAGUUUCUUGAUCU | 2136 |
| AD-70256.1 | A-141136.1 | GAAGAUCAAGAAACUUGAA | 1959 | A-141137.1 | UUCAAGUUUCUUGAUCUUCUU | 2137 |
| AD-70257.1 | A-141138.1 | GAAGAUCAAGAAACUUGAA | 1960 | A-141139.1 | UUCAAGUUUCUUGAUCUUCUU | 2138 |
| AD-70258.1 | A-141140.1 | GAAGAUCAAGAAACUUGAA | 1961 | A-141141.1 | UUCAAGUUUCUTGAUCUUCUU | 2139 |
| AD-70259.1 | A-141142.1 | GAAGAUCAAGAAACTUGAA | 1962 | A-141141.1 | UUCAAGUUUCUTGAUCUUCUU | 2140 |
| AD-70260.1 | A-141143.1 | AAGAAGAUCAAGAAACUUGAA | 1963 | A-141144.1 | UUCAAGUUUCUUGAUCUUCUU | 2141 |
| AD-70261.1 | A-141145.1 | CAAAGGAAUUCUCGGAAAG | 1964 | A-141146.1 | CUUUCCGAGAAUUCCUUUGAU | 2142 |
| AD-70262.1 | A-141145.1 | CAAAGGAAUUCUCGGAAAG | 1965 | A-141147.1 | CUUUCCGAGAAUUCCUUUGAU | 2143 |

TABLE 31-continued

Unmodified Sense and Antisense Strand Sequences of HDV dsRNAs

| Duple Name | Sense Oligo Name | Senses Sequence (5' to 3') | SEQ ID NO: | Antisense Oligo Name | Antisense Sequence (5' to 3') | SEQ ID NO: |
|---|---|---|---|---|---|---|
| AD-70263.1 | A-141148.1 | CAAAGGAAUUCUCGGAAAG | 1966 | A-141149.1 | CUUUCCGAGAAUUCCUUUGAU | 2144 |
| AD-70264.1 | A-141150.1 | CAAAGGAAUUCUCGGAAAG | 1967 | A-141151.1 | CUUUCCGAGAAUCCUUUGAU | 2145 |
| AD-70265.1 | A-141152.1 | CAAAGGAAUUCUCGCAAAG | 1968 | A-141151.1 | CUUUCCGAGAAUCCUUUGAU | 2146 |
| AD-70266.1 | A-141153.1 | AUCAAAGGAAUUCUCGGAAAG | 1969 | A-141154.1 | CUUUCCGAGAAUUCCUUUGAU | 2147 |
| AD-70267.1 | A-141155.1 | CAAGAAACUUGAGGUCGAA | 1970 | A-141156.1 | UUCGACCUCAAGUUUCUUGAU | 2148 |
| AD-70268.1 | A-141155.1 | CAAGAAACUUGAGGUCGAA | 1971 | A-141157.1 | UUCGACCUCAAGUUUCUUGAU | 2149 |
| AD-70269.1 | A-141158.1 | CAAGAAACUUGAGGUCGAA | 1972 | A-141159.1 | UUCGACCUCAAGUUUCUUGAU | 2150 |
| AD-70270.1 | A-141160.1 | CAAGAAACUUGAGGUCGAA | 1973 | A-141161.1 | UUCGACCUCAAGUUUCUUGAU | 2151 |
| AD-70271.1 | A-141162.1 | CAAGAAACUUGAGGTCGAA | 1974 | A-141161.1 | UUCGACCUCAAGUUUCUUGAU | 2152 |
| AD-70272.1 | A-141163.1 | AUCAAGAAACUUGAGGUCGAA | 1975 | A-141164.1 | UUCGACCUCAAGUUUCUUGAU | 2153 |
| AD-70273.1 | A-141165.1 | GAAGAAGAUCAAGAAACUU | 1976 | A-141166.1 | AAGUUUCUUGAUCUUCUUCUU | 2154 |
| AD-70274.1 | A-141165.1 | GAAGAAGAUCAAGAAACUU | 1977 | A-141167.1 | AAGUUUCUUGAUCUUCUUCUU | 2155 |
| AD-70275.1 | A-141168.1 | GAAGAAGAUCAAGAAACUU | 1978 | A-141169.1 | AAGUUUCUUGAUCUUCUUCUU | 2156 |
| AD-70276.1 | A-141170.1 | GAAGAAGAUCAAGAAACUU | 1979 | A-141171.1 | AAGUUUCUUGAUCUUCUUCUU | 2157 |
| AD-70277.1 | A-141172.1 | GAAGAAGAUCAAGAAACUU | 1980 | A-141171.1 | AAGUUUCUUGAUCUUCUUCUU | 2158 |
| AD-70278.1 | A-141173.1 | AAGAAGAAGAUCAAGAAACUU | 1981 | A-141174.1 | AAGUUUCUUGAUCUUCUUCUU | 2159 |
| AD-70279.1 | A-141175.1 | GGAAACAUCAAAGGAAUUA | 1982 | A-141176.1 | UAAUUCCUUUGAUGUUUCCUU | 2160 |
| AD-70280.1 | A-141175.1 | GGAAACAUCAAAGGAAUUA | 1983 | A-141177.1 | UAAUUCCUUUGAUGUUUCCUU | 2161 |
| AD-70281.1 | A-141178.1 | GGAAACAUCAAAGGAAUUA | 1984 | A-141179.1 | UAAUUCCUUUGAUGUUUCCUU | 2162 |
| AD-70282.1 | A-141180.1 | GGAAACAUCAAAGGAAUUA | 1985 | A-141181.1 | UAAUUCCUUUGAUGUUUCUU | 2163 |
| AD-70283.1 | A-141182.1 | GGAAACAUCAAAGGAAUUA | 1986 | A-141183.1 | UAAUUCCUUUGAUGUUUCCUU | 2164 |
| AD-70284.1 | A-141184.1 | UGGGAAACAUCAAAGGAAUUA | 1987 | A-141185.1 | UAAUUCCUUUGAUGUUUCCCA | 2165 |
| AD-70285.1 | A-134288.1 | AAAGAAGAAGAUCAAGAAACU | 1988 | A-141186.1 | AGUUUCUUGAUCUUCUUCUUUGU | 2166 |
| AD-70286.1 | A-141187.1 | AAAGAAGAAGAUCAAGAAACU | 1989 | A-141188.1 | AGUUUCUUGAUCUUCUUCUUUGU | 2167 |
| AD-70287.1 | A-141189.1 | AAAGAAGAAGAUCAAGAAACU | 1990 | A-141190.1 | AGUUUCUUGAUCUUCUUCUUUGU | 2168 |
| AD-70288.1 | A-141191.1 | AAAGAAGAAGAUCAAGAAACU | 1991 | A-141190.1 | AGUUUCUUGAUCUUCUUCUUUGU | 2169 |
| AD-70289.1 | A-141192.1 | AAAGAAGAAGAUCAAGAAACU | 1992 | A-141193.1 | AGUUUCUUGAUCUUCUUCUUU | 2170 |
| AD-70290.1 | A-141194.1 | AGAAGAAGAUCAAGAAACU | 1993 | A-141195.1 | AGUUUCUUGAUCUUCUUCUUU | 2171 |
| AD-70291.1 | A-141194.1 | AGAAGAAGAUCAAGAAACU | 1994 | A-141196.1 | AGUUUCUUGAUCUUCUUCUUU | 2172 |
| AD-70292.1 | A-141197.1 | AGAAGAAGAUCAAGAAACU | 1995 | A-141198.1 | AGUUUCUUGAUCUUCUUCUUU | 2173 |
| AD-70293.1 | A-141199.1 | AGAAGAAGAUCAAGAAACU | 1996 | A-141200.1 | AGUUUCUUGAUCUUCUUCUUU | 2174 |
| AD-70294.1 | A-141201.1 | AGAAGAAGAUCAAGAAACU | 1997 | A-141200.1 | AGUUUCUUGAUCUUCUUCUUU | 2175 |
| AD-70295.1 | A-141202.1 | AGAAGAAGAUCAAGAAACU | 1998 | A-141203.1 | AGUUUCUUGAUCUUCUUCU | 2176 |
| AD-70296.1 | A-141204.1 | AACAUCAAAGGAAUUCUCA | 1999 | A-141205.1 | UGAGAAUUCCUUUGAUGUUUU | 2177 |
| AD-70297.1 | A-141204.1 | AACAUCAAAGGAAUUCUCA | 2000 | A-141206.1 | UGAGAAUUCCUUUGAUGUUUU | 2178 |
| AD-70298.1 | A-141207.1 | AACAUCAAAGGAAUUCUCA | 2001 | A-141208.1 | UGAGAAUUCCUUUGAUGUUUU | 2179 |
| AD-70299.1 | A-141209.1 | AACAUCAAAGGAAUUCUCA | 2002 | A-141210.1 | UGAGAAUUCCUUGAUGUUUU | 2180 |

TABLE 31-continued

Unmodified Sense and Antisense Strand Sequences of HDV dsRNAs

| Duple Name | Sense Oligo Name | Senses Sequence (5' to 3') | SEQ ID NO: | Antisense Oligo Name | Antisense Sequence (5' to 3') | SEQ ID NO: |
|---|---|---|---|---|---|---|
| AD-70300.1 | A-141211.1 | AACAUCAAAGGAAUTCUCA | 2003 | A-141210.1 | UGAGAAUUCCUUGAUGUUUU | 2181 |
| AD-70301.1 | A-141212.1 | AACAUCAAAGGAAUUCUCA | 2004 | A-141213.1 | UGAGAAUUCCUUUGAUGUU | 2182 |
| AD-70302.1 | A-141214.1 | AGGAAUUCUCGGAAAGAAA | 2005 | A-141215.1 | UUUCUUUCCGAGAAUUCCUUU | 2183 |
| AD-70303.1 | A-141214.1 | AGGAAUUCUCGGAAAGAAA | 2006 | A-141216.1 | UUUCUUUCCGAGAAUUCCUUU | 2184 |
| AD-70304.1 | A-141217.1 | AGGAAUUCUCGGAAAGAAA | 2007 | A-141218.1 | UUUCUUUCCGAGAAUUCCUUU | 2185 |
| AD-70305.1 | A-141219.1 | AGGAAUUCUCGGAAAGAAA | 2008 | A-141220.1 | UUUCUUUCCGAGAAUUCCUUU | 2186 |
| AD-70306.1 | A-141221.1 | AGGAAUUCUCGGAAAGAAA | 2009 | A-141220.1 | UUUCUUUCCGAGAAUUCCUUU | 2187 |
| AD-70307.1 | A-141222.1 | AAAGGAAUUCUCGGAAAGAAA | 2010 | A-141223.1 | UUUCUUUCCGAGAAUUCCUUU | 2188 |
| AD-70308.1 | A-141224.1 | AAAGGAAUUCUCGGAAAGA | 2011 | A-141225.1 | UCUUUCCGAGAAUUCCUUUUU | 2189 |
| AD-70309.1 | A-141224.1 | AAAGGAAUUCUCGGAAAGA | 2012 | A-141226.1 | UCUUUCCGAGAAUUCCUUUUU | 2190 |
| AD-70310.1 | A-141227.1 | AAAGGAAUUCUCGGAAAGA | 2013 | A-141228.1 | UCUUUCCGAGAAUUCCUUUUU | 2191 |
| AD-70311.1 | A-141229.1 | AAAGGAAUUCUCGGAAAGA | 2014 | A-141230.1 | UCUUUCCGAGAAUUCCUUUUU | 2192 |
| AD-70312.1 | A-141231.1 | AAAGGAAUUCUCGGAAAGA | 2015 | A-141230.1 | UCUUUCCGAGAAUUCCUUUUU | 2193 |
| AD-70313.1 | A-141232.1 | UCAAAGGAAUUCUCGGAAAGA | 2016 | A-141233.1 | UCUUUCCGAGAAUUCCUUUGA | 2194 |

TABLE 32

Modified Sense and Antisense Strand Sequences of HDV dsRNAs

| Duplex Name | Sense Oligo Name | Sense Sequence (5'3' | SEQ ID NO: |
|---|---|---|---|
| AD-67176.1 | A-134242.1 | uscsccaaGfaAfGfGfccaaaagagaL96 | 2195 |
| AD-67177.1 | A-134244.1 | asgsuuucUfuGfAfUfcuucuucuuuL96 | 2196 |
| AD-67178.1 | A-134246.1 | uscsuuuuCfuGfAfUfaaagaggagaL96 | 2197 |
| AD-67179.1 | A-134248.1 | asgsugguAfaAfAfGfAfguauuggaaaL96 | 2198 |
| AD-67180.1 | A-134250.1 | csuscaagUfuUfCfUfugaucuucuuL96 | 2199 |
| AD-67181.1 | A-134252.1 | asasggccAfaAfAfGfagaauacaaaL96 | 2200 |
| AD-67182.1 | A-134254.1 | gsasccucAfaGfUfUfucuugaucuuL96 | 2201 |
| AD-67183.1 | A-134256.1 | asgsgccaAfaAfAfGfAfgaauacaagaL96 | 2202 |
| AD-67184.1 | A-134258.1 | csgsauagAfgAfAfUfcgagagaaaaL96 | 2203 |
| AD-67185.1 | A-134260.1 | gsasuagaGfaAfUfCfgagagaaaagL96 | 2204 |
| AD-67186.1 | A-134262.1 | ascsccacAfaAfUfCfucucuagauuL96 | 2205 |
| AD-67187.1 | A-134264.1 | gsgsauggGfaAfGfGfAfguauauccuaL96 | 2206 |
| AD-67188.1 | A-134266.1 | cscsgauaGfaGfAfAfucgagagaaaL96 | 2207 |
| AD-67189.1 | A-134268.1 | uscscgauAfgAfGfGfAfaucgagagaaL96 | 2208 |
| AD-67190.1 | A-134270.1 | usgsagugGfaAfAfCfAfccgcuuuauuL96 | 2209 |
| AD-67191.1 | A-134272.1 | cscsuucuUfuCfCfCfGfagaauuccuuL96 | 2210 |
| AD-67192.1 | A-134274.1 | csusgugaGfuGfGfGfAfaacccgcuuuL96 | 2211 |

TABLE 32-continued

Modified Sense and Antisense Strand Sequences of HDV dsRNAs

| | | | |
|---|---|---|---|
| AD-67193.1 | A-134276.1 | gsascccaCfaAfAfUfcucucuagauL96 | 2212 |
| AD-67194.1 | A-134278.1 | gscsugggAfaAfCfAfucaaaggaauL96 | 2213 |
| AD-67195.1 | A-134280.1 | ascsaguuGfaAfAfGfgcucaaggagL96 | 2214 |
| AD-67196.1 | A-134282.1 | asasggagGfaGfGfAfacgaguccgaL96 | 2215 |
| AD-67197.1 | A-134284.1 | uscsuccuCfuUfUfAfucagaaaagaL96 | 2216 |
| AD-67198.1 | A-134286.1 | uscscagcAfgUfCfUfccucuuuauaL96 | 2217 |
| AD-67199.1 | A-134288.1 | asasagaaGfaAfGfAfucaagaaacuL96 | 2218 |
| AD-67200.1 | A-134290.1 | asasgaagAfaGfAfUfcaagaaacuuL96 | 2219 |
| AD-67201.1 | A-134292.1 | gsasggucGfaAfAfAfucccuggcuaL96 | 2220 |
| AD-67202.1 | A-134294.1 | cscscuggCfuGfGfGfaaacaucaaaL96 | 2221 |
| AD-67203.1 | A-134296.1 | csusggcuGfgGfAfAfacaucaaagaL96 | 2222 |
| AD-67204.1 | A-134298.1 | usgsgcugGfgAfAfAfcaucaaaggaL96 | 2223 |
| AD-67205.1 | A-134300.1 | gsgsgcuggGfaAfAfAfCfaucaaaggaaL96 | 2224 |
| AD-67206.1 | A-134302.1 | uscsaaagGfaAfUfUfcucggaaagaL96 | 2225 |
| AD-67207.1 | A-134304.1 | usgsgggaaAfcAfUfCfaaaggaauuaL96 | 2226 |
| AD-67208.1 | A-134306.1 | gsgsaaacAfuCfAfAfaggaauucuaL96 | 2227 |
| AD-67209.1 | A-134308.1 | gsasaacaUfcAfAfAfggaauucucaL96 | 2228 |
| AD-67210.1 | A-134310.1 | asasacauCfaAfAfGfgaauucucgaL96 | 2229 |
| AD-67211.1 | A-134312.1 | csasucaaAfgGfAfAfuucucggaaaL96 | 2230 |
| AD-67212.1 | A-134314.1 | asasaggaAfuUfCfUfcggaaagaaaL96 | 2231 |
| AD-67213.1 | A-134316.1 | asasgggaaUfuCfUfCfggaaagaagaL96 | 2232 |
| AD-67214.1 | A-134320.1 | gsgsccccuCfgAfGfAfacaagaagaaL96 | 2233 |
| AD-67215.1 | A-134322.1 | gscsccucGfaGfAfAfcaagaagaaaL96 | 2234 |
| AD-67216.1 | A-134324.1 | cscscucgAfgAfAfCfaagaagaaaL96 | 2235 |
| AD-67217.1 | A-134326.1 | gsgsaaagGfaAfAfAfgaagaguagaL96 | 2236 |
| AD-67218.1 | A-134328.1 | asasgggaaAfaGfAfAfgaguagccgaL96 | 2237 |
| AD-67219.1 | A-134330.1 | gsgsggguGfuGfAfAfcccccucgaaL96 | 2238 |
| AD-67220.1 | A-134332.1 | gsgsguguGfaAfCfCfcccucgaagaL96 | 2239 |
| AD-67250.1 | A-134346.1 | Y44AGUUUCUUGAUCUUCUUCUUu | 2240 |
| AD-67251.1 | A-134348.1 | Y44UCUUUUCUGAUAAAGAGGAGa | 2241 |
| AD-67252.1 | A-134350.1 | Y44AGUGGUAAAGAGUAUUGGAAa | 2242 |
| AD-67253.1 | A-134352.1 | Y44CUCAAGUUUCUUGAUCUUCUu | 2243 |
| AD-67254.1 | A-134354.1 | Y44AAGGCCAAAAGAGAAUACAAa | 2244 |
| AD-67255.1 | A-134358.1 | Y44AGGCCAAAAGAGAAUACAAGa | 2245 |
| AD-67256.1 | A-134360.1 | Y44CGAUAGAGAAUCGAGAGAAAa | 2246 |
| AD-67257.1 | A-134362.1 | Y44GAUAGAGAAUCGAGAGAAAAg | 2247 |
| AD-67258.1 | A-134364.1 | Y44ACCCACAAAUCUCUCUAGAUu | 2248 |
| AD-67259.1 | A-134366.1 | Y44GGAUGGGAAGAGUAUAUCCa | 2249 |
| AD-67260.1 | A-134368.1 | Y44CCGAUAGAGAAUCGAGAGAAa | 2250 |

TABLE 32-continued

| Modified Sense and Antisense Strand Sequences of HDV dsRNAs | | | |
|---|---|---|---|
| AD-67261.1 | A-134370.1 | Y44UCCGAUAGAGAAUCGAGAGAa | 2251 |
| AD-67262.1 | A-134372.1 | Y44UGAGUGGAAACCCGCUUUAUu | 2252 |
| AD-67263.1 | A-134374.1 | Y44CCUUCUUUCCGAGAAUUCCUu | 2253 |
| AD-67264.1 | A-134376.1 | Y44CUGUGAGUGGAAACCCGCUUu | 2254 |
| AD-67265.1 | A-134378.1 | Y44GACCCACAAAUCUCUCUAGAu | 2255 |
| AD-67266.1 | A-134380.1 | Y44GCUGGGAAACAUCAAAGGAAu | 2256 |
| AD-67267.1 | A-134382.1 | Y44ACAGUUGGAAGGCUCAAGGAg | 2257 |
| AD-67268.1 | A-134384.1 | Y44AAGGAGGAGGAACGAGUCCGa | 2258 |
| AD-67269.1 | A-134386.1 | Y44UCUCCUCUUUAUCAGAAAAGa | 2259 |
| AD-67270.1 | A-134388.1 | Y44UCCAGCAGUCUCCUCUUUAUa | 2260 |
| AD-67271.1 | A-134390.1 | Y44AAAGAAGAAGAUCAAGAAACu | 2261 |
| AD-67272.1 | A-134392.1 | Y44AAGAAGAAGAUCAAGAAACUu | 2262 |
| AD-67273.1 | A-134394.1 | Y44GAGGUCGAAAAUCCCUGGCUa | 2263 |
| AD-67274.1 | A-134396.1 | Y44CCCUGGCUGGGAAACAUCAAa | 2264 |
| AD-67275.1 | A-134398.1 | Y44CUGGCUGGGAAACAUCAAAGa | 2265 |
| AD-67276.1 | A-134400.1 | Y44UGGCUGGGAAACAUCAAAGGa | 2266 |
| AD-67277.1 | A-134402.1 | Y44GGCUGGGAAACAUCAAAGGAa | 2267 |
| AD-67278.1 | A-134404.1 | Y44UCAAAGGAAUUCUCGGAAAGa | 2268 |
| AD-67279.1 | A-134406.1 | Y44UGGGAAACAUCAAAGGAAUUa | 2269 |
| AD-67280.1 | A-134408.1 | Y44GGAAACAUCAAAGGAAUUCUa | 2270 |
| AD-67281.1 | A-134410.1 | Y44GAAACAUCAAAGGAAUUCUCa | 2271 |
| AD-67282.1 | A-134414.1 | Y44CAUCAAAGGAAUUCUCGGAAa | 2272 |
| AD-67283.1 | A-134416.1 | Y44AAAGGAAUUCUCGGAAAGAAa | 2273 |
| AD-67284.1 | A-134418.1 | Y44AAGGAAUUCUCGGAAAGAAGa | 2274 |
| AD-67285.1 | A-134420.1 | Y44ACGAAGGAAGGCCCUCGAGAa | 2275 |
| AD-67286.1 | A-134422.1 | Y44GGCCCUCGAGAACAAGAAGAa | 2276 |
| AD-67287.1 | A-134424.1 | Y44GCCCUCGAGAACAAGAAGAAa | 2277 |
| AD-67288.1 | A-134426.1 | Y44CCCUCGAGAACAAGAAGAAGa | 2278 |
| AD-67289.1 | A-134428.1 | Y44GGAAAGGAAAAGAAGAGUAGa | 2279 |
| AD-67290.1 | A-134430.1 | Y44AAGGAAAAGAAGAGUAGCCGa | 2280 |
| AD-67291.1 | A-134432.1 | Y44GGGGGUGUGAACCCCCUCGAa | 2281 |
| AD-67292.1 | A-134434.1 | Y44GGGUGUGAACCCCCUCGAAGa | 2282 |
| AD-70224.1 | A-141079.1 | asasacUfuGfAfGfgucgaaaauaL96 | 2283 |
| AD-70225.1 | A-141081.1 | asasacuuGfAfGfgucgaaaauaL96 | 2284 |
| AD-70226.1 | A-141083.1 | asasacuuGfaGfgucgaaaauaL96 | 2285 |
| AD-70227.1 | A-141085.1 | asasacuuGfaGfgucga(Agn)aauaL96 | 2286 |
| AD-70228.1 | A-141086.1 | asGfsaaacuuGfaGfguCfgAfaaausa | 2287 |
| AD-70229.1 | A-141090.1 | gsasucaaGfAfAfacuugagguaL96 | 2288 |
| AD-70230.1 | A-141092.1 | gsasucaaGfaAfacuugagguaL96 | 2289 |

TABLE 32-continued

Modified Sense and Antisense Strand Sequences of HDV dsRNAs

| | | | |
|---|---|---|---|
| AD-70231.1 | A-141094.1 | gsasucaaGfaAfacuug(Agn)gguaL96 | 2290 |
| AD-70232.1 | A-141095.1 | asAfsgaucaaGfaAfacUfuGfaggusa | 2291 |
| AD-70233.1 | A-141097.1 | uscsaaGfaAfAfCfuugaggucgaL96 | 2292 |
| AD-70234.1 | A-141097.1 | uscsaaGfaAfAfCfuugaggucgaL96 | 2293 |
| AD-70235.1 | A-141100.1 | uscsaagaAfAfCfuugaggucgaL96 | 2294 |
| AD-70236.1 | A-141102.1 | uscsaagaAfaCfuugaggucgaL96 | 2295 |
| AD-70237.1 | A-141104.1 | uscsaagaAfaCfuugagdCucgaL96 | 2296 |
| AD-70238.1 | A-141105.1 | usCfsaagaAfaCfuugaGfgUfcgsa | 2297 |
| AD-70239.1 | A-141107.1 | asasgaUfcAfAfGfaaacuugagaL96 | 2298 |
| AD-70240.1 | A-141107.1 | asasgaUfcAfAfGfaaacuugagaL96 | 2299 |
| AD-70241.1 | A-141110.1 | asasgaucAfAfGfaaacuugagaL96 | 2300 |
| AD-70242.1 | A-141112.1 | asasgaucAfaGfaaacuugagaL96 | 2301 |
| AD-70243.1 | A-141114.1 | asasgaucAfaGfaaacu(Agn)gagaL96 | 2302 |
| AD-70244.1 | A-141115.1 | asGfsaagaucAfaGfaaAfcUfugagsa | 2303 |
| AD-70245.1 | A-141117.1 | csasucAfaAfGfGfaauucucggaL96 | 2304 |
| AD-70246.1 | A-141119.1 | csasucaaAfGfGfaauucucggaL96 | 2305 |
| AD-70247.1 | A-141121.1 | csasucaaAfgGfaauucucggaL96 | 2306 |
| AD-70248.1 | A-141123.1 | csasucaaAfgGfaauuc(Tgn)cggaL96 | 2307 |
| AD-70249.1 | A-141124.1 | asAfscaucaaAfgGfaaUfuCfucggsa | 2308 |
| AD-70250.1 | A-141126.1 | asuscaAfgAfAfAfcuugaggucaL96 | 2309 |
| AD-70251.1 | A-141126.1 | asuscaAfgAfAfAfcuugaggucaL96 | 2310 |
| AD-70252.1 | A-141129.1 | asuscaagAfAfAfcuugaggucaL96 | 2311 |
| AD-70253.1 | A-141131.1 | asuscaagAfaAfcuugaggucaL96 | 2312 |
| AD-70254.1 | A-141133.1 | asuscaagAfaAfcuugadCgucaL96 | 2313 |
| AD-70255.1 | A-141134.1 | asGfsaucaagAfaAfcuUfgAfggucsa | 2314 |
| AD-70256.1 | A-141136.1 | gsasagAfuCfAfAfgaaacuugaaL96 | 2315 |
| AD-70257.1 | A-141138.1 | gsasagauCfAfAfgaaacuugaaL96 | 2316 |
| AD-70258.1 | A-141140.1 | gsasagauCfaAfgaaacuugaaL96 | 2317 |
| AD-70259.1 | A-141142.1 | gsasagauCfaAfgaaac(Tgn)ugaaL96 | 2318 |
| AD-70260.1 | A-141143.1 | asAfsgaagauCfaAfgaAfaCfuugasa | 2319 |
| AD-70261.1 | A-141145.1 | csasaagGfaAfUfUfcucggaaagL96 | 2320 |
| AD-70262.1 | A-141145.1 | csasaagGfaAfUfUfcucggaaagL96 | 2321 |
| AD-70263.1 | A-141148.1 | csasaaggaAfUfUfcucggaaagL96 | 2322 |
| AD-70264.1 | A-141150.1 | csasaaggaAfuUfcucggaaagL96 | 2323 |
| AD-70265.1 | A-141152.1 | csasaaggaAfuUfcucgdCaaagL96 | 2324 |
| AD-70266.1 | A-141153.1 | asUfscaaaggaAfuUfcuCfgGfaaasg | 2325 |
| AD-70267.1 | A-141155.1 | csasagAfaAfCfUfugaggucgaaL96 | 2326 |
| AD-70268.1 | A-141155.1 | csasagAfaAfCfUfugaggucgaaL96 | 2327 |
| AD-70269.1 | A-141158.1 | csasagaaAfCfUfugaggucgaaL96 | 2328 |

TABLE 32-continued

| Modified Sense and Antisense Strand Sequences of HDV dsRNAs | | | |
|---|---|---|---|
| AD-70270.1 | A-141160.1 | csasagaaAfcUfugaggucgaaL96 | 2329 |
| AD-70271.1 | A-141162.1 | csasagaaAfcUfugagg(Tgn)cgaaL96 | 2330 |
| AD-70272.1 | A-141163.1 | asUfscaagaaAfcUfugAfgGfucgasa | 2331 |
| AD-70273.1 | A-141165.1 | gsasagAfaGfAfUfcaagaaacuuL96 | 2332 |
| AD-70274.1 | A-141165.1 | gsasagAfaGfAfUfcaagaaacuuL96 | 2333 |
| AD-70275.1 | A-141168.1 | gsasagaaGfAfUfcaagaaacuuL96 | 2334 |
| AD-70276.1 | A-141170.1 | gsasagaaGfaUfcaagaaacuuL96 | 2335 |
| AD-70277.1 | A-141172.1 | gsasagaaGfaUfcaaga(Agn)acuuL96 | 2336 |
| AD-70278.1 | A-141173.1 | asAfsgaagaaGfaUfcaAfgAfaacusu | 2337 |
| AD-70279.1 | A-141175.1 | gsgsaaAfcAfUfCfaaaggaauuaL96 | 2338 |
| AD-70280.1 | A-141175.1 | gsgsaaAfcAfUfCfaaaggaauuaL96 | 2339 |
| AD-70281.1 | A-141178.1 | gsgsaaacAfUfCfaaaggaauuaL96 | 2340 |
| AD-70282.1 | A-141180.1 | gsgsaaacAfuCfaaaggaauuaL96 | 2341 |
| AD-70283.1 | A-141182.1 | gsgsaaacAfuCfaaagg(Agn)auuaL96 | 2342 |
| AD-70284.1 | A-141184.1 | usGfsggaaacAfuCfaaAfgGfaauusa | 2343 |
| AD-70285.1 | A-134288.1 | asasagaaGfaAfGfAfucaagaaacuL96 | 2344 |
| AD-70286.1 | A-141187.1 | asasagaagaAfGfAfucaagaaacuL96 | 2345 |
| AD-70287.1 | A-141189.1 | asasagaagaAfgAfucaagaaacuL96 | 2346 |
| AD-70288.1 | A-141191.1 | asasagaagaAfgAfucaag(Agn)aacuL96 | 2347 |
| AD-70289.1 | A-141192.1 | asAfsagaagaAfgAfucAfaGfaaacsu | 2348 |
| AD-70290.1 | A-141194.1 | asgsaaGfaAfGfAfucaagaaacuL96 | 2349 |
| AD-70291.1 | A-141194.1 | asgsaaGfaAfGfAfucaagaaacuL96 | 2350 |
| AD-70292.1 | A-141197.1 | asgsaagaAfGfAfucaagaaacuL96 | 2351 |
| AD-70293.1 | A-141199.1 | asgsaagaAfgAfucaagaaacuL96 | 2352 |
| AD-70294.1 | A-141201.1 | asgsaagaAfgAfucaag(Agn)aacuL96 | 2353 |
| AD-70295.1 | A-141202.1 | asGfsaagaAfgAfucaaGfaAfacsu | 2354 |
| AD-70296.1 | A-141204.1 | asascaUfcAfAfAfggaauucucaL96 | 2355 |
| AD-70297.1 | A-141204.1 | asascaUfcAfAfAfggaauucucaL96 | 2356 |
| AD-70298.1 | A-141207.1 | asascaucAfAfAfggaauucucaL96 | 2357 |
| AD-70299.1 | A-141209.1 | asascaucAfaAfggaauucucaL96 | 2358 |
| AD-70300.1 | A-141211.1 | asascaucAfaAfggaau(Tgn)cucaL96 | 2359 |
| AD-70301.1 | A-141212.1 | asAfscaucAfaAfggaaUfuCfucsa | 2360 |
| AD-70302.1 | A-141214.1 | asgsgaAfuUfCfUfcggaaagaaaL96 | 2361 |
| AD-70303.1 | A-141214.1 | asgsgaAfuUfCfUfcggaaagaaaL96 | 2362 |
| AD-70304.1 | A-141217.1 | asgsgaauUfCfUfcggaaagaaaL96 | 2363 |
| AD-70305.1 | A-141219.1 | asgsgaauUfcUfcggaaagaaaL96 | 2364 |
| AD-70306.1 | A-141221.1 | asgsgaauUfcUfcggaa(Agn)gaaaL96 | 2365 |
| AD-70307.1 | A-141222.1 | asAfsaggaauUfcUfcgGfaAfagaasa | 2366 |
| AD-70308.1 | A-141224.1 | asasagGfaAfUfUfcucggaaagaL96 | 2367 |

TABLE 32-continued

Modified Sense and Antisense Strand Sequences of HDV dsRNAs

| | | | |
|---|---|---|---|
| AD-70309.1 | A-141224.1 | asasagGfaAfUfUfcucggaaagaL96 | 2368 |
| AD-70310.1 | A-141227.1 | asasaggaAfUfUfcucggaaagaL96 | 2369 |
| AD-70311.1 | A-141229.1 | asasaggaAfuUfcucggaaagaL96 | 2370 |
| AD-70312.1 | A-141231.1 | asasaggaAfuUfcucgg(Agn)aagaL96 | 2371 |
| AD-70313.1 | A-141232.1 | usCfsaaaggaAfuUfcuCfgGfaaagsa | 2372 |

| Duplex Name | Antisense Oligo Name | Antisense Sequence (5'3') | SEQ ID NO: |
|---|---|---|---|
| AD-67176.1 | A-134243.1 | usCfsucuUfuuggccuUfcUfugggasgsa | 2373 |
| AD-67177.1 | A-134245.1 | asAfsagaAfgaagaucAfaGfaaacsususg | 2374 |
| AD-67178.1 | A-134247.1 | usCfsuccUfcuuuaucAfgAfaaagasgsu | 2375 |
| AD-67179.1 | A-134249.1 | usUfsuccAfauacucuUfuAfccacsusus | 2376 |
| AD-67180.1 | A-134251.1 | asAfsgaaGfaucaagaAfaCfuugagsgsu | 2377 |
| AD-67181.1 | A-134253.1 | usUfsuguAfuucucuuUfuGfgccuuscsu | 2378 |
| AD-67182.1 | A-134255.1 | asAfsgauCfaagaaacUfuGfaggucsgsa | 2379 |
| AD-67183.1 | A-134257.1 | usCfsuugUfauucucuUfuUfggccusususc | 2380 |
| AD-67184.1 | A-134259.1 | usUfsuucUfcucgauuCfuCfuaucgsgsa | 2381 |
| AD-67185.1 | A-134261.1 | csUfsuuuCfcucgauUfcUfcuaucsgsg | 2382 |
| AD-67186.1 | A-134263.1 | asAfsucuAfgagagauUfuGfuggguscsc | 2383 |
| AD-67187.1 | A-134265.1 | usAfsggaUfauacucuUfcCfcauccsgsa | 2384 |
| AD-67188.1 | A-134267.1 | usUfsucuCfucgauucUfcUfaucggsasa | 2385 |
| AD-67189.1 | A-134269.1 | usUfscucUfcgauucCfuAfucggasasu | 2386 |
| AD-67190.1 | A-134271.1 | asAfsuaaAfgcggguuUfcCfacucascsa | 2387 |
| AD-67191.1 | A-134273.1 | asAfsggaAfuucucggAfaAfgaaggsasc | 2388 |
| AD-67192.1 | A-134275.1 | asAfsagcGfgguuuccAfcUfcacagsgsu | 2389 |
| AD-67193.1 | A-134277.1 | asUfscuaGfagagauuUfgUfgggucscsc | 2390 |
| AD-67194.1 | A-134279.1 | asUfsuccUfuugauguUfuCfccagcscsa | 2391 |
| AD-67195.1 | A-134281.1 | usGfsucaAfccuuccgAfgUfuccucsusu | 2392 |
| AD-67196.1 | A-134283.1 | usUfscccuCfcuccuugCfuCfaggcuscsu | 2393 |
| AD-67197.1 | A-134285.1 | usCfsuuuUfcugauaaAfgAfggagascsu | 2394 |
| AD-67198.1 | A-134287.1 | usAfsuaaAfgaggagaCfuGfcuggascsu | 2395 |
| AD-67199.1 | A-134289.1 | asGfsuuuCfuugaucuUfcUfucuuusgsu | 2396 |
| AD-67200.1 | A-134291.1 | asAfsguuUfcuugaucUfuCfuucuususg | 2397 |
| AD-67201.1 | A-134293.1 | usAfsgccAfgggauuuUfcGfaccucsasa | 2398 |
| AD-67202.1 | A-134295.1 | usUfsugaUfguuucccAfgCfcagggsasu | 2399 |
| AD-67203.1 | A-134297.1 | usCfsuuuGfauguuucCfcAfgccagsgsg | 2400 |
| AD-67204.1 | A-134299.1 | usCfscuuUfgauguuuCfcCfagccasgsg | 2401 |
| AD-67205.1 | A-134301.1 | usUfsccuUfugauguUfcCfcagccsasg | 2402 |
| AD-67206.1 | A-134303.1 | usCfsuuuCfcgagaauUfcCfuuugasusg | 2403 |
| AD-67207.1 | A-134305.1 | usAfsauuCfcuuugauGfuUfucccasgsc | 2404 |
| AD-67208.1 | A-134307.1 | usAfsgaaUfuccuuugAfuGfuuuccscsa | 2405 |

TABLE 32-continued

Modified Sense and Antisense Strand Sequences of HDV dsRNAs

| | | | |
|---|---|---|---|
| AD-67209.1 | A-134309.1 | usGfsagaAfuuccuuuGfaUfguuucscsc | 2406 |
| AD-67210.1 | A-134311.1 | usCfsgagAfauuccuuUfgAfuguuuscsc | 2407 |
| AD-67211.1 | A-134313.1 | usUfsuccGfagaauucCfuUfugaugsusu | 2408 |
| AD-67212.1 | A-134315.1 | usUfsucuUfuccgagaAfuUfccuuusgsa | 2409 |
| AD-67213.1 | A-134317.1 | usCfsuucUfuuccgagAfaUfccuususg | 2410 |
| AD-67214.1 | A-134321.1 | usUfscuuCfuuguucuCfgAfgggccsusu | 2411 |
| AD-67215.1 | A-134323.1 | usUfsucuUfcuuguucUfcGfagggcscsu | 2412 |
| AD-67216.1 | A-134325.1 | usCfsuucUfucuuguuCfuCfgagggscsc | 2413 |
| AD-67217.1 | A-134327.1 | usCfsuacUfcuucuuuUfcCfuuuccsusc | 2414 |
| AD-67218.1 | A-134329.1 | usCfsggcUfacucuucUfuUfuccuususc | 2415 |
| AD-67219.1 | A-134331.1 | usUfscgaGfggguucAfcAfcccccsasa | 2416 |
| AD-67220.1 | A-134333.1 | usCfsuucGfaggggguUfcAfcacccscsc | 2417 |
| AD-67250.1 | A-134347.1 | AAAGAAGAAGAUCAAGAAACUUg | 2418 |
| AD-67251.1 | A-134349.1 | UCUCCUCUUUAUCAGAAAAGAGu | 2419 |
| AD-67252.1 | A-134351.1 | UUUCCAAUACUCUUUACCACUUu | 2420 |
| AD-67253.1 | A-134353.1 | AAGAAGAUCAAGAAACUUGAGGu | 2421 |
| AD-67254.1 | A-134355.1 | UUUGUAUUCUCUUUUGGCCUUCu | 2422 |
| AD-67255.1 | A-134359.1 | UCUUGUAUUCUCUUUUGGCCUUc | 2423 |
| AD-67256.1 | A-134361.1 | UUUUCUCUCGAUUCUCUAUCGGa | 2424 |
| AD-67257.1 | A-134363.1 | CUUUUCUCUCGAUUCUCUAUCGg | 2425 |
| AD-67258.1 | A-134365.1 | AAUCUAGAGAGAUUUGUGGGUCc | 2426 |
| AD-67259.1 | A-134367.1 | UAGGAUAUACUCUUCCCAUCCGa | 2427 |
| AD-67260.1 | A-134369.1 | UUUCUCUCGAUUCUCUAUCGGAa | 2428 |
| AD-67261.1 | A-134371.1 | UUCUCUCGAUUCUCUAUCGGAAu | 2429 |
| AD-67262.1 | A-134373.1 | AAUAAAGCGGGUUUCCACUCACa | 2430 |
| AD-67263.1 | A-134375.1 | AAGGAAUUCUCGGAAAGAAGGAc | 2431 |
| AD-67264.1 | A-134377.1 | AAAGCGGGUUUCCACUCACAGGu | 2432 |
| AD-67265.1 | A-134379.1 | AUCUAGAGAGAUUUGUGGGUCCc | 2433 |
| AD-67266.1 | A-134381.1 | AUUCCUUUGAUGUUUCCCAGCCa | 2434 |
| AD-67267.1 | A-134383.1 | UGUCAACCUUCCGAGUUCCUCUu | 2435 |
| AD-67268.1 | A-134385.1 | UUCCUCCUCCUUGCUCAGGCUCu | 2436 |
| AD-67269.1 | A-134387.1 | UCUUUUCUGAUAAAGAGGAGACu | 2437 |
| AD-67270.1 | A-134389.1 | UAUAAAGAGGAGACUGCUGGACu | 2438 |
| AD-67271.1 | A-134391.1 | AGUUUCUUGAUCUUCUUCUUUGu | 2439 |
| AD-67272.1 | A-134393.1 | AAGUUUCUUGAUCUUCUUCUUUg | 2440 |
| AD-67273.1 | A-134395.1 | UAGCCAGGGAUUUUCGACCUCAa | 2441 |
| AD-67274.1 | A-134397.1 | UUUGAUGUUUCCCAGCCAGGGAu | 2442 |
| AD-67275.1 | A-134399.1 | UCUUUGAUGUUUCCCAGCCAGGg | 2443 |
| AD-67276.1 | A-134401.1 | UCCUUUGAUGUUUCCCAGCCAGg | 2444 |

TABLE 32-continued

Modified Sense and Antisense Strand Sequences of HDV dsRNAs

| | | | |
|---|---|---|---|
| AD-67277.1 | A-134403.1 | UUCCUUUGAUGUUUCCCAGCCAg | 2445 |
| AD-67278.1 | A-134405.1 | UCUUUCCGAGAAUUCCUUUGAUg | 2446 |
| AD-67279.1 | A-134407.1 | UAAUUCCUUUGAUGUUUCCCAGc | 2447 |
| AD-67280.1 | A-134409.1 | UAGAAUUCCUUUGAUGUUUCCCa | 2448 |
| AD-67281.1 | A-134411.1 | UGAGAAUUCCUUUGAUGUUUCCc | 2449 |
| AD-67282.1 | A-134415.1 | UUUCCGAGAAUUCCUUUGAUGUu | 2450 |
| AD-67283.1 | A-134417.1 | UUUCUUUCCGAGAAUUCCUUUGa | 2451 |
| AD-67284.1 | A-134419.1 | UCUUCUUUCCGAGAAUUCCUUUg | 2452 |
| AD-67285.1 | A-134421.1 | UUCUCGAGGGCCUUCCUUCGUCg | 2453 |
| AD-67286.1 | A-134423.1 | UUCUUCUUGUUCUCGAGGGCCUu | 2454 |
| AD-67287.1 | A-134425.1 | UUUCUUCUUGUUCUCGAGGGCCu | 2455 |
| AD-67288.1 | A-134427.1 | UCUUCUUCUUGUUCUCGAGGGCc | 2456 |
| AD-67289.1 | A-134429.1 | UCUACUCUUCUUUUCCUUUCCUc | 2457 |
| AD-67290.1 | A-134431.1 | UCGGCUACUCUUCUUUUCCUUUc | 2458 |
| AD-67291.1 | A-134433.1 | UUCGAGGGGGUUCACACCCCAa | 2459 |
| AD-67292.1 | A-134435.1 | UCUUCGAGGGGGUUCACACCCCc | 2460 |
| AD-70224.1 | A-141080.1 | usAfsuuuUfcgaccucAfaGfuuususu | 2461 |
| AD-70225.1 | A-141082.1 | usAfsuuuucgaccucAfaGfuuususu | 2462 |
| AD-70226.1 | A-141084.1 | usAfsuuuucgaccdTcAfaguuususu | 2463 |
| AD-70227.1 | A-141084.1 | usAfsuuuucgaccdTcAfaguuususu | 2464 |
| AD-70228.1 | A-141087.1 | usAfsuuuucgAfcCfucAfaGfuuucsu | 2465 |
| AD-70229.1 | A-141091.1 | usAfsccucaaguuucUfuGfaucsusu | 2466 |
| AD-70230.1 | A-141093.1 | usAfsccucaaguudTcUfugaucsusu | 2467 |
| AD-70231.1 | A-141093.1 | usAfsccucaaguudTcUfugaucsusu | 2468 |
| AD-70232.1 | A-141096.1 | usAfsccucaaGfuUfucUfuGfaucusu | 2469 |
| AD-70233.1 | A-141098.1 | usCfsgacCfuCfAfaguuUfcUfugasusu | 2470 |
| AD-70234.1 | A-141099.1 | usCfsgacCfucaaguuUfcUfugasusu | 2471 |
| AD-70235.1 | A-141101.1 | usCfsgaccucaaguuUfcUfugasusu | 2472 |
| AD-70236.1 | A-141103.1 | usCfsgaccucaagdTuUfcuugasusu | 2473 |
| AD-70237.1 | A-141103.1 | usCfsgaccucaagdTuUfcuugasusu | 2474 |
| AD-70238.1 | A-141106.1 | usCfsgaccucAfaGfuuUfcUfugsa | 2475 |
| AD-70239.1 | A-141108.1 | usCfsucaAfgUfUfucuuGfaUfcuususu | 2476 |
| AD-70240.1 | A-141109.1 | usCfsucaAfguuucuuGfaUfcuususu | 2477 |
| AD-70241.1 | A-141111.1 | usCfsucaaguuucuuGfaUfcuususu | 2478 |
| AD-70242.1 | A-141113.1 | usCfsucaaguuucdTuGfaucuususu | 2479 |
| AD-70243.1 | A-141113.1 | usCfsucaaguuucdTuGfaucuususu | 2480 |
| AD-70244.1 | A-141116.1 | usCfsucaaguUfuCfuuGfaUfcuucsu | 2481 |
| AD-70245.1 | A-141118.1 | usCfscgaGfaauuccuUfuGfaugsusu | 2482 |
| AD-70246.1 | A-141120.1 | usCfscgagaauuccuUfuGfaugsusu | 2483 |

TABLE 32-continued

Modified Sense and Antisense Strand Sequences of HDV dsRNAs

| | | | |
|---|---|---|---|
| AD-70247.1 | A-141122.1 | usCfscgagaauucdCuUfugaugsusu | 2484 |
| AD-70248.1 | A-141122.1 | usCfscgagaauucdCuUfugaugsusu | 2485 |
| AD-70249.1 | A-141125.1 | usCfscgagaaUfuCfcuUfuGfaugusu | 2486 |
| AD-70250.1 | A-141127.1 | usGfaccUfcAfAfguuuCfuUfgaususu | 2487 |
| AD-70251.1 | A-141128.1 | usGfaccUfcaaguuuCfuUfgaususu | 2488 |
| AD-70252.1 | A-141130.1 | usGfaccucaaguuuCfuUfgaususu | 2489 |
| AD-70253.1 | A-141132.1 | usGfaccucaagudTuCfuugaususu | 2490 |
| AD-70254.1 | A-141132.1 | usGfaccucaagudTuCfuugaususu | 2491 |
| AD-70255.1 | A-141135.1 | usGfaccucaAfgUfuuCfuUfgaucsu | 2492 |
| AD-70256.1 | A-141137.1 | usUfscaaGfuuucuugAfuCfuucsusu | 2493 |
| AD-70257.1 | A-141139.1 | usUfscaaguuucuugAfuCfuucsusu | 2494 |
| AD-70258.1 | A-141141.1 | usUfscaaguuucudTgAfucuucsusu | 2495 |
| AD-70259.1 | A-141141.1 | usUfscaaguuucudTgAfucuucsusu | 2496 |
| AD-70260.1 | A-141144.1 | usUfscaaguuUfcUfugAfuCfuucusu | 2497 |
| AD-70261.1 | A-141146.1 | csUfuucCfgAfGfaauuCfcUfuugsasu | 2498 |
| AD-70262.1 | A-141147.1 | csUfuucCfgagaauuCfcUfuugsasu | 2499 |
| AD-70263.1 | A-141149.1 | csUfuuccgagaauuCfcUfuugsasu | 2500 |
| AD-70264.1 | A-141151.1 | csUfuuccgagaadTuCfcuuugsasu | 2501 |
| AD-70265.1 | A-141151.1 | csUfuuccgagaadTuCfcuuugsasu | 2502 |
| AD-70266.1 | A-141154.1 | csUfuuccgaGfaAfuuCfcUfuugasu | 2503 |
| AD-70267.1 | A-141156.1 | usUfscgaCfcUfCfaaguUfuCfuugsasu | 2504 |
| AD-70268.1 | A-141157.1 | usUfscgaCfcucaaguUfuCfuugsasu | 2505 |
| AD-70269.1 | A-141159.1 | usUfscgaccucaaguUfuCfuugsasu | 2506 |
| AD-70270.1 | A-141161.1 | usUfscgaccucaadGuUfucuugsasu | 2507 |
| AD-70271.1 | A-141161.1 | usUfscgaccucaadGuUfucuugsasu | 2508 |
| AD-70272.1 | A-141164.1 | usUfscgaccuCfaAfguUfuCfuugasu | 2509 |
| AD-70273.1 | A-141166.1 | asAfsguuUfcUfUfgaucUfuCfuucsusu | 2510 |
| AD-70274.1 | A-141167.1 | asAfsguuUfcuugaucUfuCfuucsusu | 2511 |
| AD-70275.1 | A-141169.1 | asAfsguuucuugaucUfuCfuucsusu | 2512 |
| AD-70276.1 | A-141171.1 | asAfsguuucuugadTcUfucuucsusu | 2513 |
| AD-70277.1 | A-141171.1 | asAfsguuucuugadTcUfucuucsusu | 2514 |
| AD-70278.1 | A-141174.1 | asAfsguuucuUfgAfucUfuCfuucusu | 2515 |
| AD-70279.1 | A-141176.1 | usAfsauuCfcUfUfugauGfuUfuccsusu | 2516 |
| AD-70280.1 | A-141177.1 | usAfsauuCfcuuugauGfuUfuccsusu | 2517 |
| AD-70281.1 | A-141179.1 | usAfsauuccuuugauGfuUfuccsusu | 2518 |
| AD-70282.1 | A-141181.1 | usAfsauuccuuugdAuGfuuucsusu | 2519 |
| AD-70283.1 | A-141183.1 | usAfsauuccuuugdAuGfuuuccsusu | 2520 |
| AD-70284.1 | A-141185.1 | usAfsauuccuUfuGfauGfuUfuccsa | 2521 |
| AD-70285.1 | A-141186.1 | asGfsuuuCfuUfGfaucuUfcUfucuuusgsu | 2522 |

TABLE 32-continued

Modified Sense and Antisense Strand Sequences of HDV dsRNAs

| | | | |
|---|---|---|---|
| AD-70286.1 | A-141188.1 | asGfsuuucuugaucuUfcUfucuuusgsu | 2523 |
| AD-70287.1 | A-141190.1 | asGfsuuucuugaudCuUfcuucuuusgsu | 2524 |
| AD-70288.1 | A-141190.1 | asGfsuuucuugaudCuUfcuucuuusgsu | 2525 |
| AD-70289.1 | A-141193.1 | asGfsuuucuuGfaUfcuUfcUfucuusu | 2526 |
| AD-70290.1 | A-141195.1 | asGfsuuuCfuUfGfaucuUfcUfucususu | 2527 |
| AD-70291.1 | A-141196.1 | asGfsuuuCfuugaucuUfcUfucususu | 2528 |
| AD-70292.1 | A-141198.1 | asGfsuuucuugaucuUfcUfucususu | 2529 |
| AD-70293.1 | A-141200.1 | asGfsuuucuugaudCuUfcuucususu | 2530 |
| AD-70294.1 | A-141200.1 | asGfsuuucuugaudCuUfcuucususu | 2531 |
| AD-70295.1 | A-141203.1 | asGfsuuucuuGfaUfcuUfcUfucsu | 2532 |
| AD-70296.1 | A-141205.1 | usGfsagaAfuUfCfcuuuGfaUfguususu | 2533 |
| AD-70297.1 | A-141206.1 | usGfsagaAfuuccuuuGfaUfguususu | 2534 |
| AD-70298.1 | A-141208.1 | usGfsagaauuccuuuGfaUfguususu | 2535 |
| AD-70299.1 | A-141210.1 | usGfsagaauuccudTuGfauguususu | 2536 |
| AD-70300.1 | A-141210.1 | usGfsagaauuccudTuGfauguususu | 2537 |
| AD-70301.1 | A-141213.1 | usGfsagaauuCfcUfuuGfaUfgusu | 2538 |
| AD-70302.1 | A-141215.1 | usUfsucuUfuCfCfgagaAfuUfccususu | 2539 |
| AD-70303.1 | A-141216.1 | usUfsucuUfuccgagaAfuUfccususu | 2540 |
| AD-70304.1 | A-141218.1 | usUfsucuuuccgagaAfuUfccususu | 2541 |
| AD-70305.1 | A-141220.1 | usUfsucuuuccgadGaAfuuccususu | 2542 |
| AD-70306.1 | A-141220.1 | usUfsucuuuccgadGaAfuuccususu | 2543 |
| AD-70307.1 | A-141223.1 | usUfsucuuucCfgAfgaAfuUfccuusu | 2544 |
| AD-70308.1 | A-141225.1 | usCfsuuuCfcGfAfgaauUfcCfuuususu | 2545 |
| AD-70309.1 | A-141226.1 | usCfsuuuCfcgagaauUfcCfuuususu | 2546 |
| AD-70310.1 | A-141228.1 | usCfsuuuccgagaauUfcCfuuususu | 2547 |
| AD-70311.1 | A-141230.1 | usCfsuuuccgagadAuUfccuuususu | 2548 |
| AD-70312.1 | A-141230.1 | usCfsuuuccgagadAuUfccuuususu | 2549 |
| AD-70313.1 | A-141233.1 | usCfsuuuccgAfgAfauUfcCfuuugsa | 2550 |

TABLE 33

HDV Single dose screen in Cos7 Cells against Antigenome and Genome constructs

| Duplex | 10 nM Avg Anti | 1 nM Avg Anti | 0.1 nM Avg Anti | 10 nM Avg Genome | 1 nM Avg Genome | 0.1 nM Avg Genome | 10 nM SD Anti | 1 nM SD Anti | 0.1 nM SD Anti | 10 nM SD Genome | 1 nM SD Genome | 0.1 nM SD Genome |
|---|---|---|---|---|---|---|---|---|---|---|---|---|
| AD-67176.1 | 79.3 | | 89.6 | 59.9 | | 77.2 | 22.9 | | 3.4 | 9.10 | | 20.6 |
| AD-67177.1 | 101.5 | | 99.1 | 39.3 | | 83.6 | 39.7 | | 14.9 | 10.76 | | 28.7 |
| AD-67178.1 | 99.6 | | 97.4 | 90.5 | | 86.7 | 12.0 | | 20.1 | 40.51 | | 41.6 |
| AD-67179.1 | 84.8 | | 88.6 | 63.2 | | 81.3 | 12.1 | | 15.2 | 19.52 | | 28.2 |
| AD-67180.1 | 77.7 | | 108.6 | 41.0 | | 93.2 | 15.1 | | 26.8 | 13.25 | | 33.6 |
| AD-67181.1 | 169.3 | | 92.9 | 47.9 | | 92.3 | 6.2 | | 8.9 | 8.51 | | 25.0 |
| AD-67182.1 | 62.1 | | 102.6 | 43.6 | | 86.3 | 11.4 | | 22.0 | 12.92 | | 28.7 |
| AD-67183.1 | 89.3 | | 105.0 | 65.4 | | 99.2 | 13.9 | | 14.7 | 4.65 | | 34.1 |
| AD-67184.1 | 49.9 | | 102.4 | 96.4 | | 102.7 | 10.6 | | 16.4 | 25.05 | | 20.7 |
| AD-67185.1 | 87.1 | | 87.7 | 80.9 | | 81.0 | 23.9 | | 4.5 | 18.19 | | 19.7 |

TABLE 33-continued

HDV Single dose screen in Cos7 Cells against Antigenome and Genome constructs

| Duplex | 10 nM Avg Anti | 1 nM Avg Anti | 0.1 nM Avg Anti | 10 nM Avg Genome | 1 nM Avg Genome | 0.1 nM Avg Genome | 10 nM SD Anti | 1 nM SD Anti | 0.1 nM SD Anti | 10 nM SD Genome | 1 nM SD Genome | 0.1 nM SD Genome |
|---|---|---|---|---|---|---|---|---|---|---|---|---|
| AD-67186.1 | 102.4 | | 109.4 | 81.7 | | 82.6 | 20.2 | | 12.7 | 12.49 | | 4.9 |
| AD-67187.1 | 72.0 | | 93.2 | 87.7 | | 95.4 | 7.4 | | 11.1 | 13.69 | | 23.2 |
| AD-67188.1 | 68.1 | | 110.5 | 127.7 | | 97.3 | 12.8 | | 14.9 | 18.70 | | 26.5 |
| AD-67189.1 | 84.3 | | 95.9 | 104.7 | | 98.9 | 16.9 | | 15.0 | 23.72 | | 26.2 |
| AD-67190.1 | 104.5 | | 115.3 | 110.5 | | 101.5 | 2.7 | | 7.2 | 24.53 | | 5.1 |
| AD-67191.1 | 72.9 | | 99.8 | 72.8 | | 92.2 | 8.4 | | 8.1 | 21.61 | | 14.0 |
| AD-67192.1 | 124.2 | | 106.4 | 96.4 | | 113.5 | 25.6 | | 18.2 | 22.27 | | 36.9 |
| AD-67193.1 | 91.3 | | 105.3 | 105.2 | | 121.4 | 12.8 | | 21.7 | 25.63 | | 41.9 |
| AD-67194.1 | 39.4 | | 84.8 | 97.5 | | 105.9 | 9.0 | | 3.1 | 12.31 | | 32.6 |
| AD-67195.1 | 90.1 | | 110.7 | 87.5 | | 98.7 | 11.7 | | 10.4 | 20.22 | | 11.7 |
| AD-67196.1 | 75.5 | | 107.9 | 102.1 | | 85.5 | 3.6 | | 5.5 | 2.71 | | 14.3 |
| AD-67197.1 | 68.8 | | 98.6 | 80.2 | | 96.0 | 5.3 | | 13.5 | 15.68 | | 23.1 |
| AD-67198.1 | 49.5 | | 101.2 | 106.2 | | 111.0 | 2.7 | | 12.7 | 20.42 | | 15.9 |
| AD-67199.1 | 27.1 | | 72.4 | 162.7 | | 87.3 | 4.9 | | 11.4 | 23.09 | | 21.3 |
| AD-67200.1 | 24.1 | | 76.7 | 128.5 | | 114.2 | 4.0 | | 4.2 | 13.53 | | 24.3 |
| AD-67201.1 | 58.1 | | 88.6 | 100.1 | | 86.0 | 9.9 | | 17.3 | 26.61 | | 24.4 |
| AD-67202.1 | 30.3 | | 92.1 | 107.3 | | 110.5 | 4.1 | | 13.6 | 27.71 | | 17.9 |
| AD-67203.1 | 55.3 | | 99.6 | 109.7 | | 99.8 | 4.0 | | 8.0 | 28.27 | | 26.2 |
| AD-67204.1 | 71.6 | | 101.4 | 111.1 | | 107.5 | 7.7 | | 12.0 | 49.72 | | 29.2 |
| AD-67205.1 | 54.2 | | 95.4 | 89.3 | | 90.2 | 6.4 | | 14.7 | 17.80 | | 24.2 |
| AD-67206.1 | 52.4 | | 89.9 | 106.9 | | 103.8 | 12.6 | | 7.0 | 19.47 | | 36.2 |
| AD-67207.1 | 57.6 | | 99.4 | 102.6 | | 109.5 | 11.1 | | 21.9 | 9.58 | | 9.6 |
| AD-67208.1 | 31.2 | | 89.5 | 87.4 | | 102.7 | 3.5 | | 8.9 | 15.91 | | 27.3 |
| AD-67209.1 | 47.1 | | 90.6 | 97.8 | | 78.5 | 6.3 | | 10.7 | 18.03 | | 25.7 |
| AD-67210.1 | 31.7 | | 95.4 | 96.2 | | 92.8 | 1.8 | | 14.4 | 14.11 | | 28.7 |
| AD-67211.1 | 25.4 | | 79.8 | 110.2 | | 93.4 | 6.5 | | 9.5 | 23.84 | | 27.4 |
| AD-67212.1 | 32.2 | | 93.9 | 90.7 | | 67.7 | 4.9 | | 5.8 | 22.15 | | 23.4 |
| AD-67213.1 | 49.2 | | 97.7 | 97.4 | | 75.5 | 5.2 | | 9.6 | 17.73 | | 25.9 |
| AD-67214.1 | 56.8 | | 92.7 | 97.8 | | 99.4 | 9.6 | | 10.1 | 20.89 | | 21.4 |
| AD-67215.1 | 39.0 | | 99.2 | 92.1 | | 95.4 | 11.3 | | 5.5 | 6.57 | | 11.4 |
| AD-67216.1 | 57.1 | | 94.3 | 91.2 | | 87.5 | 12.6 | | 11.9 | 18.27 | | 25.2 |
| AD-67217.1 | 63.4 | | 101.4 | 90.0 | | 96.2 | 2.1 | | 10.7 | 15.73 | | 25.7 |
| AD-67218.1 | 65.8 | | 97.3 | 91.1 | | 86.6 | 10.3 | | 7.1 | 11.42 | | 21.2 |
| AD-67219.1 | 77.3 | | 100.4 | 83.9 | | 89.8 | 1.7 | | 7.8 | 18.81 | | 40.2 |
| AD-67220.1 | 78.8 | | 102.2 | 87.6 | | 77.8 | 15.2 | | 7.9 | 7.96 | | 11.5 |
| AD-67250.1 | 85.3 | | 92.4 | 29.0 | | 74.3 | 4.4 | | 11.6 | 3.72 | | 22.8 |
| AD-67251.1 | 90.2 | | 104.3 | 101.9 | | 91.7 | 25.6 | | 18.0 | 25.07 | | 12.2 |
| AD-67252.1 | 99.6 | | 108.6 | 59.6 | | 64.9 | 8.2 | | 3.6 | 18.48 | | 13.7 |
| AD-67253.1 | 50.0 | | 94.6 | 32.9 | | 73.5 | 3.3 | | 15.8 | 14.44 | | 18.2 |
| AD-67254.1 | 193.2 | | 106.8 | 63.7 | | 68.2 | 47.1 | | 6.1 | 22.95 | | 12.7 |
| AD-67255.1 | 83.7 | | 94.5 | 38.2 | | 66.7 | 25.7 | | 13.7 | 8.71 | | 9.5 |
| AD-67256.1 | 88.8 | | 94.3 | 113.1 | | 106.0 | 22.8 | | 9.4 | 37.17 | | 26.3 |
| AD-67257.1 | 51.8 | | 101.2 | 105.6 | | 93.7 | 5.2 | | 4.6 | 26.52 | | 22.3 |
| AD-67258.1 | 81.6 | | 102.7 | 92.2 | | 92.4 | 24.4 | | 6.2 | 39.25 | | 26.5 |
| AD-67259.1 | 113.1 | | 104.8 | 81.2 | | 71.9 | 18.8 | | 16.7 | 30.40 | | 9.6 |
| AD-67260.1 | 52.1 | | 112.2 | 67.4 | | 74.6 | 8.1 | | 8.8 | 4.21 | | 10.8 |
| AD-67261.1 | 73.8 | | 96.2 | 96.1 | | 99.5 | 15.5 | | 9.1 | 7.96 | | 17.8 |
| AD-67262.1 | 110.6 | | 106.5 | 127.0 | | 115.6 | 28.0 | | 15.3 | 20.20 | | 3.0 |
| AD-67263.1 | 69.4 | | 96.3 | 49.7 | | 63.1 | 16.7 | | 8.8 | 4.00 | | 14.8 |
| AD-67264.1 | 180.6 | | 104.6 | 100.1 | | 94.9 | 43.2 | | 22.3 | 37.56 | | 10.7 |
| AD-67265.1 | 122.5 | | 117.0 | 119.1 | | 99.4 | 23.3 | | 19.7 | 13.26 | | 18.6 |
| AD-67266.1 | 24.3 | | 59.3 | 115.8 | | 83.6 | 1.0 | | 3.8 | 34.70 | | 14.0 |
| AD-67267.1 | 83.4 | | 113.8 | 92.6 | | 82.7 | 13.9 | | 11.8 | 26.19 | | 10.6 |
| AD-67268.1 | 99.2 | | 101.2 | 81.0 | | 94.9 | 14.9 | | 11.1 | 21.50 | | 22.4 |
| AD-67269.1 | 42.9 | | 81.7 | 179.2 | | 86.0 | 6.6 | | 6.5 | 50.94 | | 13.2 |
| AD-67270.1 | 33.9 | | 85.7 | 125.2 | | 85.6 | 5.9 | | 10.8 | 24.45 | | 12.7 |
| AD-67271.1 | 29.6 | | 53.4 | 156.0 | | 115.8 | 8.9 | | 10.9 | 27.82 | | 27.2 |
| AD-67272.1 | 13.4 | | 46.3 | 136.9 | | 128.4 | 2.3 | | 4.4 | 23.52 | | 30.3 |
| AD-67273.1 | 15.9 | | 57.5 | 105.1 | | 82.1 | 4.6 | | 4.4 | 26.59 | | 13.3 |
| AD-67274.1 | 25.8 | | 60.4 | 86.8 | | 93.4 | 2.0 | | 10.2 | 14.89 | | 22.4 |
| AD-67275.1 | 46.5 | | 75.4 | 131.1 | | 94.3 | 12.3 | | 9.5 | 46.37 | | 18.0 |
| AD-67276.1 | 20.8 | | 59.4 | 87.7 | | 88.0 | 2.2 | | 4.4 | 10.78 | | 18.2 |
| AD-67277.1 | 17.2 | | 49.5 | 93.4 | | 92.4 | 2.3 | | 4.7 | 44.06 | | 19.4 |
| AD-67278.1 | 25.1 | | 61.3 | 131.5 | | 94.8 | 8.4 | | 6.8 | 30.75 | | 10.0 |
| AD-67279.1 | 21.9 | | 78.3 | 111.7 | | 126.9 | 4.8 | | 10.8 | 19.15 | | 15.0 |
| AD-67280.1 | 32.8 | | 78.1 | 154.7 | | 109.4 | 4.3 | | 9.1 | 52.47 | | 29.4 |
| AD-67281.1 | 32.8 | | 60.0 | 163.7 | | 110.1 | 2.4 | | 9.0 | 20.60 | | 8.6 |
| AD-67282.1 | 19.3 | | 47.6 | 129.1 | | 109.7 | 4.8 | | 9.1 | 18.16 | | 21.2 |
| AD-67283.1 | 34.5 | | 71.8 | 193.2 | | 112.4 | 14.0 | | 1.1 | 66.11 | | 10.7 |
| AD-67284.1 | 51.2 | | 76.9 | 126.9 | | 94.1 | 5.2 | | 7.9 | 40.77 | | 26.8 |
| AD-67285.1 | 17.3 | | 68.6 | 66.9 | | 110.7 | 1.9 | | 10.7 | 26.05 | | 25.3 |
| AD-67286.1 | 29.5 | | 85.5 | 87.3 | | 125.7 | 5.8 | | 10.7 | 13.51 | | 30.7 |
| AD-67287.1 | 33.1 | | 83.5 | 84.9 | | 98.8 | 12.2 | | 22.2 | 33.27 | | 12.9 |
| AD-67288.1 | 14.4 | | 75.1 | 73.3 | | 109.2 | 6.5 | | 5.2 | 15.93 | | 16.1 |

TABLE 33-continued

HDV Single dose screen in Cos7 Cells against Antigenome and Genome constructs

| Duplex | 10 nM Avg Anti | 1 nM Avg Anti | 0.1 nM Avg Anti | 10 nM Avg Genome | 1 nM Avg Genome | 0.1 nM Avg Genome | 10 nM SD Anti | 1 nM SD Anti | 0.1 nM SD Anti | 10 nM SD Genome | 1 nM SD Genome | 0.1 nM SD Genome |
|---|---|---|---|---|---|---|---|---|---|---|---|---|
| AD-67289.1 | 38.8 | | 66.4 | 97.9 | | 102.0 | 15.6 | | 7.9 | 22.42 | | 19.0 |
| AD-67290.1 | 20.9 | | 81.2 | 89.6 | | 112.4 | 4.8 | | 9.3 | 11.83 | | 8.4 |
| AD-67291.1 | 47.8 | | 100.0 | 107.1 | | 95.2 | 4.7 | | 19.7 | 16.82 | | 9.3 |
| AD-67292.1 | 99.9 | | 99.3 | 129.3 | | 136.5 | 22.7 | | 20.8 | 39.06 | | 58.4 |
| AD-70224.1 | 46.5 | 68.6 | 94.0 | 99.6 | 113.6 | 103.5 | 10.2 | 8.7 | 2.5 | 13.9 | 6.9 | 10.0 |
| AD-70225.1 | 49.1 | 76.2 | 88.9 | 129.9 | 107.0 | 87.1 | 7.2 | 0.8 | 5.3 | 45.3 | 6.1 | 10.0 |
| AD-70226.1 | 65.3 | | | 105.4 | | | 8.0 | | | 23.9 | | |
| AD-70227.1 | 37.7 | 58.7 | 84.3 | 173.3 | 111.4 | 101.7 | 8.2 | 3.2 | 5.1 | 15.5 | 6.2 | 5.5 |
| AD-70228.1 | 102.4 | 120.8 | 107.9 | 46.3 | 52.2 | 82.3 | 10.7 | 5.7 | 14.3 | 11.4 | 2.5 | 3.6 |
| AD-70229.1 | 32.0 | 65.6 | 96.9 | 92.1 | 107.2 | 89.6 | 3.5 | 0.1 | 1.9 | 6.8 | 25.7 | 5.5 |
| AD-70230.1 | 36.7 | 66.7 | 99.2 | 91.8 | 100.1 | 91.9 | 3.9 | 11.4 | 13.6 | 8.2 | 14.9 | 12.5 |
| AD-70231.1 | 26.7 | 62.6 | 86.3 | 97.3 | 93.9 | 122.5 | 4.0 | 5.2 | 2.4 | 25.6 | 2.7 | 35.5 |
| AD-70232.1 | 16.1 | 35.2 | 74.5 | 40.1 | 33.3 | 73.9 | 2.7 | 2.7 | 0.9 | 15.0 | 6.5 | 10.9 |
| AD-70233.1 | 24.8 | 71.7 | 96.0 | 91.8 | 106.4 | 96.2 | 1.6 | 1.0 | 1.2 | 10.4 | 9.2 | 0.5 |
| AD-70234.1 | 29.6 | 63.0 | 90.2 | 89.4 | 102.5 | 99.9 | 5.1 | 0.1 | 3.5 | 8.5 | 3.4 | 6.3 |
| AD-70235.1 | 35.4 | 84.5 | 104.2 | 66.6 | 101.9 | 97.8 | 10.5 | 4.2 | 9.7 | 13.0 | 1.2 | 6.2 |
| AD-70236.1 | 39.4 | 64.8 | 95.2 | 86.3 | 88.3 | 94.0 | 3.7 | 3.0 | 0.6 | 5.7 | 3.8 | 6.7 |
| AD-70237.1 | 22.1 | 49.4 | 83.8 | 96.2 | 90.3 | 87.6 | 2.5 | 0.1 | 1.7 | 19.1 | 9.4 | 2.8 |
| AD-70238.1 | 26.5 | 61.4 | 91.8 | 60.9 | 72.9 | 82.7 | 1.6 | 0.8 | 6.7 | 6.8 | 5.4 | 1.9 |
| AD-70239.1 | 73.7 | | | 99.1 | | | 8.4 | | | 20.7 | | |
| AD-70240.1 | 80.0 | | | 82.4 | | | 11.0 | | | 8.3 | | |
| AD-70241.1 | 82.5 | | | 107.4 | | | 2.1 | | | 21.9 | | |
| AD-70242.1 | 69.5 | | | 90.2 | | | 4.7 | | | 28.9 | | |
| AD-70243.1 | 33.5 | 57.4 | 102.5 | 109.3 | 106.4 | 80.7 | 3.5 | 1.2 | 8.2 | 20.7 | 17.0 | 2.8 |
| AD-70244.1 | 78.5 | 93.3 | 99.9 | 22.6 | 29.3 | 85.9 | 6.2 | 1.8 | 4.5 | 4.2 | 5.0 | 12.2 |
| AD-70245.1 | 44.7 | 71.2 | 83.2 | 109.7 | 91.5 | 98.5 | 3.3 | 2.4 | 1.5 | 15.1 | 3.9 | 8.9 |
| AD-70246.1 | 42.1 | 79.0 | 104.6 | 97.2 | 99.0 | 97.0 | 1.0 | 4.9 | 13.5 | 25.8 | 4.7 | 6.9 |
| AD-70247.1 | 60.3 | | | 75.2 | | | 6.5 | | | 6.8 | | |
| AD-70248.1 | 20.9 | 45.2 | 82.2 | 86.5 | 121.9 | 98.2 | 2.1 | 6.9 | 3.8 | 10.0 | 3.5 | 2.4 |
| AD-70249.1 | 72.4 | 93.6 | 96.7 | 39.9 | 38.5 | 81.3 | 4.2 | 6.7 | 1.5 | 13.1 | 7.4 | 10.1 |
| AD-70250.1 | 35.0 | 72.9 | 97.5 | 81.7 | 91.4 | 89.8 | 3.6 | 3.1 | 16.8 | 8.5 | 2.0 | 5.2 |
| AD-70251.1 | 47.2 | 71.8 | 92.6 | 87.6 | 101.5 | 105.3 | 5.5 | 6.5 | 0.8 | 12.2 | 1.3 | 11.8 |
| AD-70252.1 | 55.7 | | | 76.2 | | | 6.7 | | | 6.1 | | |
| AD-70253.1 | 61.5 | | | 68.8 | | | 3.9 | | | 16.5 | | |
| AD-70254.1 | 30.0 | 65.2 | 93.1 | 83.1 | 92.0 | 111.6 | 0.8 | 1.4 | 2.6 | 9.8 | 15.2 | 0.8 |
| AD-70255.1 | 65.0 | 89.1 | 90.4 | 32.6 | 50.7 | 92.0 | 5.2 | 1.6 | 2.6 | 6.9 | 8.8 | 2.0 |
| AD-70256.1 | 17.9 | 45.9 | 89.0 | 107.7 | 126.3 | 95.6 | 2.3 | 0.6 | 6.6 | 17.1 | 24.6 | 5.3 |
| AD-70257.1 | 19.7 | 41.8 | 78.1 | 129.4 | 104.7 | 96.7 | 3.8 | 0.7 | 3.3 | 28.2 | 16.6 | 3.9 |
| AD-70258.1 | 25.9 | 51.4 | 83.8 | 120.5 | 104.3 | 77.0 | 2.6 | 3.8 | 8.2 | 25.8 | 0.2 | 7.1 |
| AD-70259.1 | 15.0 | 26.0 | 70.3 | 131.5 | 117.4 | 100.5 | 1.7 | 0.2 | 4.0 | 16.7 | 3.8 | 1.0 |
| AD-70260.1 | 21.9 | 43.2 | 85.4 | 44.7 | 39.3 | 103.6 | 4.3 | 1.3 | 6.4 | 9.1 | 0.9 | 6.7 |
| AD-70261.1 | 83.1 | | | 82.1 | | | 4.2 | | | 10.7 | | |
| AD-70262.1 | 85.6 | | | 81.5 | | | 7.2 | | | 13.1 | | |
| AD-70263.1 | 92.8 | | | 116.9 | | | 4.7 | | | 50.7 | | |
| AD-70264.1 | 82.3 | | | 120.8 | | | 5.5 | | | 53.7 | | |
| AD-70265.1 | 38.1 | 72.2 | 95.2 | 130.9 | 98.6 | 90.5 | 4.1 | 1.7 | 3.1 | 29.9 | 0.8 | 12.6 |
| AD-70266.1 | 85.8 | | | 90.3 | | | 11.3 | | | 19.5 | | |
| AD-70267.1 | 15.0 | 27.8 | 66.1 | 123.5 | 122.8 | 103.0 | 1.3 | 1.7 | 2.8 | 15.5 | 4.1 | 8.8 |
| AD-70268.1 | 15.8 | 30.3 | 78.2 | 116.7 | 123.1 | 103.6 | 2.0 | 1.8 | 1.8 | 22.7 | 6.9 | 5.3 |
| AD-70269.1 | 16.0 | 27.9 | 71.1 | 106.9 | 99.8 | 99.2 | 1.7 | 1.7 | 0.6 | 19.5 | 9.4 | 26.9 |
| AD-70270.1 | 26.1 | 54.7 | 89.1 | 108.8 | 102.8 | 93.4 | 4.5 | 4.4 | 10.6 | 31.1 | 1.6 | 14.2 |
| AD-70271.1 | 15.3 | 26.8 | 62.8 | 115.4 | 125.0 | 106.9 | 3.3 | 2.3 | 4.3 | 13.5 | 6.9 | 3.7 |
| AD-70272.1 | 15.1 | 33.3 | 82.3 | 53.3 | 31.4 | 70.3 | 2.7 | 2.1 | 11.2 | 15.0 | 5.3 | 12.4 |
| AD-70273.1 | 26.8 | 49.5 | 85.2 | 150.6 | 133.9 | 111.2 | 4.9 | 6.4 | 2.1 | 36.0 | 0.4 | 0.6 |
| AD-70274.1 | 23.2 | 36.5 | 87.3 | 177.6 | 123.0 | 109.8 | 2.8 | 0.5 | 0.6 | 27.1 | 2.2 | 21.5 |
| AD-70275.1 | 20.0 | 43.9 | 76.1 | 178.4 | 151.1 | 103.7 | 4.1 | 4.7 | 3.0 | 32.2 | 10.4 | 8.1 |
| AD-70276.1 | 32.1 | 43.6 | 84.1 | 183.4 | 130.6 | 67.5 | 1.8 | 2.3 | 2.1 | 14.9 | 12.2 | 5.0 |
| AD-70277.1 | 29.7 | 33.8 | 73.2 | 213.9 | 140.7 | 109.2 | 6.4 | 4.9 | 2.8 | 20.5 | 8.8 | 9.7 |
| AD-70278.1 | 25.2 | 41.4 | 73.6 | 57.8 | 56.0 | 95.3 | 5.9 | 1.1 | 5.7 | 12.1 | 2.6 | 4.7 |
| AD-70279.1 | 79.8 | | | 135.6 | | | 7.4 | | | 22.9 | | |
| AD-70280.1 | 100.4 | | | 162.0 | | | 14.5 | | | 17.5 | | |
| AD-70281.1 | 82.2 | | | 161.7 | | | 13.1 | | | 10.6 | | |
| AD-70282.1 | 105.1 | | | 116.2 | | | 5.3 | | | 16.9 | | |
| AD-70283.1 | 64.4 | | | 134.4 | | | 7.7 | | | 23.3 | | |
| AD-70284.1 | 95.4 | | | 106.1 | | | 11.0 | | | 5.3 | | |
| AD-70285.1 | 91.6 | | | 119.4 | | | 11.6 | | | 7.9 | | |
| AD-70286.1 | 84.0 | | | 110.3 | | | 8.8 | | | 21.6 | | |
| AD-70287.1 | 89.9 | | | 96.7 | | | 4.4 | | | 7.5 | | |
| AD-70288.1 | 29.1 | 74.0 | 89.9 | 199.1 | 132.5 | 110.7 | 5.8 | 7.8 | 2.7 | 58.5 | 26.6 | 2.8 |
| AD-70289.1 | 32.7 | 44.4 | 84.5 | 77.7 | 60.0 | 76.8 | 5.3 | 1.4 | 2.6 | 11.4 | 5.7 | 1.4 |
| AD-70290.1 | 102.0 | | | 102.6 | | | 13.6 | | | 17.4 | | |
| AD-70291.1 | 100.7 | | | 110.1 | | | 8.5 | | | 24.6 | | |
| AD-70292.1 | 76.7 | | | 131.9 | | | 5.2 | | | 20.2 | | |
| AD-70293.1 | 99.7 | | | 131.7 | | | 5.8 | | | 29.7 | | |

TABLE 33-continued

HDV Single dose screen in Cos7 Cells against Antigenome and Genome constructs

| Duplex | 10 nM Avg Anti | 1 nM Avg Anti | 0.1 nM Avg Anti | 10 nM Avg Genome | 1 nM Avg Genome | 0.1 nM Avg Genome | 10 nM SD Anti | 1 nM SD Anti | 0.1 nM SD Anti | 10 nM SD Genome | 1 nM SD Genome | 0.1 nM SD Genome |
|---|---|---|---|---|---|---|---|---|---|---|---|---|
| AD-70294.1 | 103.1 | | | 124.4 | | | 5.4 | | | 35.4 | | |
| AD-70295.1 | 101.8 | | | 125.9 | | | 6.3 | | | 10.4 | | |
| AD-70296.1 | 104.3 | | | 106.8 | | | 11.1 | | | 11.9 | | |
| AD-70297.1 | 105.2 | | | 105.8 | | | 6.0 | | | 38.9 | | |
| AD-70298.1 | 103.1 | | | 99.9 | | | 5.0 | | | 19.1 | | |
| AD-70299.1 | 108.1 | | | 100.9 | | | 12.9 | | | 24.6 | | |
| AD-70300.1 | 109.6 | | | 80.5 | | | 13.3 | | | 8.3 | | |
| AD-70301.1 | 99.4 | | | 97.2 | | | 7.0 | | | 11.0 | | |
| AD-70302.1 | 101.9 | | | 104.6 | | | 17.2 | | | 27.3 | | |
| AD-70303.1 | 77.1 | | | 133.0 | | | 6.4 | | | 27.0 | | |
| AD-70304.1 | 119.5 | | | 108.7 | | | 12.4 | | | 10.3 | | |
| AD-70305.1 | 91.1 | | | 115.5 | | | 8.2 | | | 22.6 | | |
| AD-70306.1 | 103.7 | | | 140.3 | | | 15.5 | | | 19.8 | | |
| AD-70307.1 | 75.4 | | | 98.0 | | | 3.8 | | | 14.0 | | |
| AD-70308.1 | 105.5 | | | 136.1 | | | 7.7 | | | 30.9 | | |
| AD-70309.1 | 109.5 | | | 92.8 | | | 23.5 | | | 14.6 | | |
| AD-70310.1 | 111.6 | | | 109.7 | | | 11.5 | | | 27.1 | | |
| AD-70311.1 | 101.8 | | | 111.5 | | | 10.2 | | | 25.1 | | |
| AD-70312.1 | 113.8 | | | 91.0 | | | 8.3 | | | 26.1 | | |
| AD-70313.1 | 114.8 | | | 76.9 | | | 10.0 | | | 13.1 | | |

TABLE 34

Dose response screen in Cos7 cells

| Duplex | Antigenome, IC50 nM | Genome, IC50 nM | Antigenome hot spot, IC50 nM | Genome hot spot, IC50 nM |
|---|---|---|---|---|
| AD-67176.1 | not achieved | not achieved | | |
| AD-67177.1 | not achieved | not achieved | | |
| AD-67180.1 | not achieved | 3124.5 | | |
| AD-67181.1 | not achieved | >10000 | | |
| AD-67182.1 | not achieved | >10000 | | |
| AD-67199.1 | 288.0 | not achieved | | |
| AD-67200.1 | 466.2 | not achieved | | |
| AD-67202.1 | >10000 | not achieved | | |
| AD-67208.1 | not achieved | not achieved | | |
| AD-67210.1 | >10000 | not achieved | | |
| AD-67211.1 | 1100.8 | not achieved | | |
| AD-70228.1 | | | not achieved | 23.0 |
| AD-70232.1 | 405.4 | 5002.4 | 33.7 | 9.0 |
| AD-70238.1 | | | 273.9 | 122.4 |
| AD-70244.1 | | 1589.9 | not achieved | 14.7 |
| AD-70249.1 | | 2377.2 | 2376.2 | 13.1 |
| AD-70255.1 | | | 3082.4 | 26.1 |
| AD-70259.1 | 173.2 | | | |
| AD-70260.1 | 419.2 | 7185.0 | 50.3 | 8.7 |
| AD-70266.1 | | | not achieved | 476.4 |
| AD-70267.1 | 185.7 | | | |
| AD-70268.1 | 174.6 | | | |
| AD-70269.1 | 267.6 | | | |
| AD-70271.1 | 119.6 | | | |
| AD-70272.1 | 364.8 | 3400.4 | 30.2 | 22.2 |
| AD-70274.1 | 258.8 | | | |
| AD-70277.1 | 190.6 | | | |
| AD-70278.1 | | | 57.1 | 30.6 |
| AD-70284.1 | | | not achieved | 4670.5 |
| AD-70289.1 | | | not achieved | not achieved |
| AD-70295.1 | | | 61.8 | 39.4 |
| AD-70301.1 | | | not achieved | not achieved |
| AD-70307.1 | | | 2329.6 | 379.0 |
| AD-70313.1 | | | not achieved | not achieved |

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (2552 sequences)

SEQ ID NO: 1 - DNA, 3215 bp, Hepatitis B virus
ctccacaacattccaccaagctctgctagatcccagagtgaggggcctatattttcctgctggtggctccagttccggaacagtaaaccctgttccgactactgcctcacccatatcgtcaatcttctcgaggactggggaccctgcaccgaacatggagagcacaacatcaggattcctaggacccctgctcgtgttacaggcggggtttttcttgttgacaagaatcctcacaataccacagagtctagactcgtggtggacttctctcaattttctagggggagcacccacgtgtcctggccaaaattcgcagtccccaacctccaatcactcaccaacctcttgtcctccaacttgtcctggctatcgctggatgtgtctgcggcgttttatcatattcctcttcatcctgctgctatgcctcatcttcttgttggttcttctggactaccaaggtatgttgcccgtttgtcctctacttccaggaacatcaactaccagcacgggaccatgcagaacctgcacgattcctgctcaaggaacctctatgtttccctcttgttgctgtacaaaaccttcggacggaaactgcacttgtattcccatcccatcatcctgggctttcgcaagattcctatgggagtgggcctcagtccgtttctcctggctcagtttactagtgccatttgttcagtggttcgtagggctttcccccactgtttggctttcagctatatggatgatgtggtattgggggccaagtctgtacaacatcttgagtccctttttacctctattaccaattttcttttgtctttgggtatacatttgaaccctaataaaaccaaacgttggggctactcccttaacttcatgggatatgtaattggaagttggggtactttaccgcaggaacatattgtacaaaaactcaagcaatgttttcgaaaattgcctgtaaatagacctattgattggaaagtatgtcaaagaattgtgggtcttttgggctttgctgccccttttacacaatgtggctatcctgccttgatgcctttatatgcatgtatacaatctaagcaggctttcactttctcgccaacttacaaggcctttctgtgtaaacaatatctaaacctttaccccgttgcccggcaacggtcaggtctctgccaagtgtttgctgacgcaacccccacgggttggggcttggccataggccatcggcgcatgcgtggaacctttgtggctcctctgccgatccatactgcggaactcctagcagcttgttttgctcgcagccggtctggagcgaaacttatcggaaccgacaactcagttgtcctctctcggaaatacacctcctttccatggctgctaggctgtgctgccaactggatcctgcgcgggacgtcctttgtctacgtcccgtcggcgctgaatcccgcggacgacccgtctcggggccgtttgggcctctaccgtccccttcttcatctgccgttccggccgaccacggggcgcacctctctttacgcggtctccccgtctgtgccttctcatctgccggaccgtgtgcacttcgcttcacctctgcacgtagcatggagaccaccgtgaacgcccaccaggtcttgcccaaggtcttacacaagaggactcttggactctcagcaatgtcaacgaccgaccttgaggcatacttcaaagactgtttgtttaaagactgggaggagttgggggaggagattaggttaaaggtctttgtactaggaggctgtaggcataaattggtctgttcaccagcaccatgcaactttttcccctctgcctaatcatctcatgttcatgtcctactgttcaagcctccaagctgtgccttgggtggctttggggcatggacattgacccgtataaagaatttggagcttctgtggagttactctcttttttgccttctgacttctttccttctattcgagatctcctcgacaccgcctctgctctgtatcgggaggccttagagtctccggaacattgttcacctcaccatacagcactcaggcaagctattctgtgttggggtgagttgatgaatctggccacctgggtgggaagtaatttggaagacccagcatccagggaattagtagtcagctatgtcaatgttaatatgggcctaaaaattagacaactattgtggtttcacatttcctgccttacttttggaagagaaactgtccttgagtatttggtgtcttttggagtgtggattcgcactcctcccgcttacagaccaccaaatgcccctatcttatcaacacttccggaaactactgttgttagacgacgaggcaggtcccctagaagaagaactccctcgcctcgcagacgaaggtctcaatcgccgcgtcgcagaagatctcaatctcgggaatctcaatgttagtatcccttggactcataaggtgggaaactttactgggctttattcttctactgtacctgtctttaatcctgattggaaaactccctcctttcctcacattcatttacaggaggacattattaatagatgtcaacaatatgtgggccctctgacagttaatgaaaaaaggagattaaaattaattatgcctgctaggttctatcctaaccttaccaaatatttgcccttggacaaaggcattaaaccgtattatcctgaatatgcagttaatcattacttcaaaactaggcattatttacatactctgtggaaggctggcattctatataagagagaaactacacgcagcgcctcattttgtgggtcaccatattcttgggaacaagagctacagcatgggaggttggtcttccaaacctcgacaaggcatggggacgaatctttctgttcccaatcctctgggattctttcccgatcaccagttggaccctgcgttcggagccaactcaaacaatccagattgggacttcaaccccaacaaggatcactggccagaggcaaatcaggtaggagcgggagcatttggtccagggttcaccccaccacacggaggccttttggggtggagccctcaggctcagggcatattgacaacactgccagcagcacctcctcctgcctccaccaatcggcagtcaggaagacagcctactcccatctctccacctctaagagacagtcatcctcaggccatgcagtggaa

SEQ ID NO: 2 - DNA, 3215 bp, Hepatitis B virus
ttccactgcatggcctgaggatgactgtctcttagaggtggagagatgggagtaggctgtcttcctgactgccgattggtggaggcaggaggaggtgctgctggcagtgttgtcaatatgccctgagcctgagggctccaccccaaaaggcctccgtgtggtggggtgaaccctggaccaaatgctcccgctcctacctgatttgcctctggccagtgatccttgttggggttgaagtcccaatctggattgtttgagttggctccgaacgcagggtccaactggtgatcgggaaagaatcccagaggattgggaacagaaagattcgtccccatgccttgtcgaggtttggaagaccaacctcccatgctgtagctcttgttcccaagaatatggtgacccacaaaatgaggcgctgcgtgtagtttctctcttatatagaatgccagccttccacagagtatgtaaataatgcctagttttgaagtaatgattaactgcatattcaggataatacggtttaatgcctttgtccaagggcaaatatttggtaaggttaggatagaacctagcaggcataattaattttaatctccttttttcattaactgtcagagggcccacatattgttgacatctattaataatgtcctcctgtaaatgaatgtgaggaaaggagggagttttccaatcaggattaaagacaggtacagtagaagaataaagcccagtaaagtttcccaccttatgagtccaagggatactaacattgagattcccgagattgagatcttctgcgacgcggcgattgagaccttcgtctgcgaggcgagggagttcttcttctaggggacctgcctcgtcgtctaacaacagtagtttccggaagtgttgataagataggggcatttggtggtctgtaagcgggaggagtgcgaatccacactccaaaagacaccaaatactcaaggacagtttctcttccaaaagtaaggcaggaaatgtgaaaccacaatagttgtctaatttttaggcccatattaacattgacatagctgactactaattccctggatgctgggtcttccaaattacttcccacccaggtggccagattcatcaactcaccccaacacagaatagcttgcctgagtgctgtatggtgaggtgaacaatgttccggagactctaaggcctcccgatacagagcagaggcggtgtcgaggagatctcgaatagaaggaaagaagtcagaaggcaaaaaagagagtaactccacagaagctccaaattctttatacgggtcaatgtccatgccccaaagccacccaaggcacagcttggaggcttgaacagtaggacatgaacatgagatgattaggcagaggggaaaaagttgcatggtgctggtgaacagaccaatttatgcctacagcctcctagtacaaagacctttaacctaatctcctcccccaactcctcccagtctttaaacaaacagtctttgaagtatgcctcaaggtcggtcgttgacattgctgagagtccaagagtcctcttgtgtaagaccttgggcaagacctggtgggcgttcacggtggtctccatgctacgtgcagaggtgaagcgaagtgcacacggtccggcagatgagaaggcacagacggggagaccgcgtaaagagaggtgcgccccgtggtcggccggaacggcagatgaagaaggggacggtagaggcccaaacggccccgagacgggtcgtccgcgggattcagcgccgacgggacgtagacaaaggacgtcccgcgcaggatccagttggcagcacagcctagcagccatggaaaggaggtgtatttccgagagaggacaactgagttgtcggttccgataagtttcgctccagaccggctgcgagcaaaacaagctgctaggagttccgcagtatggatcggcagaggagccacaaaggttccacgcatgcgccgatggcctatggccaagccccaacccgtgggggttgcgtcagcaaacacttggcagagacctgaccgttgccgggcaacggggtaaaggtttagatattgtttacacagaaaggccttgtaagttggcgagaaagtgaaagcctgcttagattgtatacatgcatataaaggcatcaaggcaggatagccacattgtgtaaaaggggcagcaaagcccaaaagacccacaattctttgacatactttccaatcaataggtctatttacaggcaattttcgaaaacattgcttgagtttttgtacaatatgttcctgcggtaaagtaccccaacttccaattacatatcccatgaagttaagggagtagccccaacgtttggttttattagggttcaaatgtatacccaaagacaaaagaaaattggtaatagaggtaaaaagggactcaagatgttgtacagacttggcccccaataccacatcatccatatagctgaaagccaaacagtgggggaaagccctacgaaccactgaacaaatggcactagtaaactgagccaggagaaacggactgaggcccactcccataggaatcttgcgaaagcccaggatgatgggatgggaatacaagtgcagtttccgtccgaaggttttgtacagcaacaagagggaaacatagaggttccttgagcaggaatcgtgcaggttctgcatggtcccgtgctggtagttgatgttcctggaagtagaggacaaacgggcaacataccttggtagtccagaagaaccaacaagaagatgaggcatagcagcaggatgaagaggaatatgataaaacgccgcagacacatccagcgatagccaggacaagttggaggacaagaggttggtgagtgattggaggttggggactgcgaattttggccaggacacgtgggtgctccccctagaaaattgagagaagtccaccacgagtctagactctgtggtattgtgaggattcttgtcaacaagaaaaaccccgcctgtaacacgagcaggggtcctaggaatcctgatgttgtgctctccatgttcggtgcagggtccccagtcctcgagaagattgacgatatgggtgaggcagtagtcggaacagggtttactgttccggaactggagccaccagcaggaaaatataggcccctcactctgggatctagcagagcttggtggaatgttgtggag

SEQ ID NO: 3 - DNA, 3215 bp, Hepatitis B virus
  modified_base (2768)..(2768): a, c, t, g, unknown or other
ctccaccacattccaccaagctctgctacaccccagagtaaggggcctatactttcctgctggtggctccagttccggaacagtaaaccctgttccgactactgcctctcccatatcgtcaatcttctcgaggactggggaccctgcaccgaacatggagaacacaacatcaggattcctaggacccctgctcgtgttacaggcggggtttttcttgttgacaagaatcctcacaataccacagagtctagactcgtggtggacttctctcaattttctagggggagcacccacgtgtcctggccaaaattcgcagtccccaacctccaatcactcaccaacctcttgtcctccaatttgtcctggctatcgctggatgtgtctgcggcgttttatcatattcctcttcatcctgctgctatgcctcatcttcttgttggttcttctggactaccaaggtatgttgcccgtttgtcctctacttccaggaacatcaactaccagcacgggaccatgcaagacctgcacgattcctgctcaaggcacctctatgtttccctcttgttgctgtacaaaaccttcggacggaaactgcacttgtattcccatcccatcatcctgggctttcgcaagattcctatgggagtgggcctcagtccgtttctcctggctcagtttactagtgccatttgttcagtggttcgtagggctttcccccactgtttggctttcagttatatggatgatgtggtattgggggccaagtctgtacaacatcttgagtccctttttaccgctgttaccaattttcttttgtctttgggtatacatttgaaccctaataaaaccaaacgttggggttactcccttaacttcatgggatatgtaattggaagttggggtactttaccgcaagaccatattgtactaaaaatcaagcaatgttttcgaaaactgcctgtaaatagacctattgattggaaagtatgtcagagaattgtgggtcttttgggctttgctgccccttttacacaatgtggctatcctgccttaatgcctttatatgcatgtatacaatctaagcaggctttcactttctcgccaacttacaaggcctttctgtgtaaacaatatctgaacctttaccccgttgcccggcaacggtcaggtctctgccaagtgtttgctgacgcaacccccactggatggggcttggctattggccatcgccgcatgcgtggaacctttgtggctcctctgccgatccatactgcggaactcctagcagcttgttttgctcgcagccggtctggagcgaaactgatcggaacggacaactctgttgttctctctcggaaatacacctcctttccatggctgctagggtgtgctgccaactggatcctgcgcgggacgtcctttgtttacgtcccgtcggcgctgaatcccgcggacgacccatctcggggccgtttgggtctctaccgtccccttcttcatctgccgttccggccgaccacggggcgcacctctctttacgcggtctccccgtctgtgccttctcatctgccggaccgtgtgcacttcgcttcacctctgcacgtcgcatggagaccaccgtgaacgcccaccaggtcttgcccaaggtcttatataagaggactcttggactctcagcaatgtcaacgaccgaccttgaggcatacttcaaagactgtttgtttaaggactgggaggagttgggggaggagattaggttaatgatctttgtactaggaggctgtaggcataaattggtctgttcaccagcaccatgcaactttttcacctctgcctaatcatctcatgttcatgtcctactgttcaagcctccaagctgtgccttgggtggctttaggacatggacattgacccatataaagaatttggagcttctgtggagttactctcttttttgccttctgacttttttccttctattcgagatctcctcgacaccgcctctgctctgtatcgggaggccttagagtctccggaacattgttcacctcaccatacagcactcagacaagccattctgtgttggggtgagttgatgaatctggccacctgggtgggaagtaatttggaagacccagcatccagggaattagtagtcagctatgtcaatgttaatatgggcctaaaaatcagacaactactgtggtttcacatttcctgtcttacttttggaagagaaactgttcttgagtatttggtgtcttttggagtgtggattcgcactcctcctgcttacagaccatcaaatgcccctatcttatcaacacttccggaaactactgttgttagacgacgaggcaggtcccctagaagaagaactccctcgcctcgcagacgaaggtctcaatcgccgcgtcgcagaagatctcaatctcgggaacctcaatgttagtatcccttggactcataaggtgggaaactttactgggctttattcttctactgtacctgtctttaatcctgagtggcaaactccctcttttcctcatattcatttgcaggaggacattattaatagatgtcaacaatatgtgggccctcttacagttaatgaaaaaaggagattaaaattaattatgcctgctaggttctatcctaaccttaccaaatatttgcccttggacaaaggcattaaaccatattatccggaacatgcagttaatcattacttcaaaactaggcattatttacatactctgtggaaggcnggcattctatataagagagaaactacacgcagcgcctcattttgtgggtcaccatattcttgggaacaagagctacagcatgggaggttggtcttccaaacctcgacaaggcatggggacaaatctttctgttcccaatcctctgggattctttcccgatcaccagttggaccctgcgttcggagccaactcaaacaatccagattgggacttcaaccccaacaaggatcactggccagaggcaaatcaggtaggagcgggagcattcgggccagggttcaccccaccacacggcggtcttttggggtggagccctcaggctcagggcacattgacaacagtgccagtagcacctcctcctgcctccaccaatcggcagtcaggaagacagcctactcccatctctccacctctaagagacagtcatcctcaggccatgcagtggaa

SEQ ID NO: 4 - DNA, 3215 bp, Hepatitis B virus
  modified_base (448)..(448): a, c, t, g, unknown or other
ttccactgcatggcctgaggatgactgtctcttagaggtggagagatgggagtaggctgtcttcctgactgccgattggtggaggcaggaggaggtgctactggcactgttgtcaatgtgccctgagcctgagggctccaccccaaaagaccgccgtgtggtggggtgaaccctggcccgaatgctcccgctcctacctgatttgcctctggccagtgatccttgttggggttgaagtcccaatctggattgtttgagttggctccgaacgcagggtccaactggtgatcgggaaagaatcccagaggattgggaacagaaagatttgtccccatgccttgtcgaggtttggaagaccaacctcccatgctgtagctcttgttcccaagaatatggtgacccacaaaatgaggcgctgcgtgtagtttctctcttatatagaatgccngccttccacagagtatgtaaataatgcctagttttgaagtaatgattaactgcatgttccggataatatggtttaatgcctttgtccaagggcaaatatttggtaaggttaggatagaacctagcaggcataattaattttaatctccttttttcattaactgtaagagggcccacatattgttgacatctattaataatgtcctcctgcaaatgaatatgaggaaaagagggagtttgccactcaggattaaagacaggtacagtagaagaataaagcccagtaaagtttcccaccttatgagtccaagggatactaacattgaggttcccgagattgagatcttctgcgacgcggcgattgagaccttcgtctgcgaggcgagggagttcttcttctaggggacctgcctcgtcgtctaacaacagtagtttccggaagtgttgataagataggggcatttgatggtctgtaagcaggaggagtgcgaatccacactccaaaagacaccaaatactcaagaacagtttctcttccaaaagtaagacaggaaatgtgaaaccacagtagttgtctgatttttaggcccatattaacattgacatagctgactactaattccctggatgctgggtcttccaaattacttcccacccaggtggccagattcatcaactcaccccaacacagaatggcttgtctgagtgctgtatggtgaggtgaacaatgttccggagactctaaggcctcccgatacagagcagaggcggtgtcgaggagatctcgaatagaaggaaaaaagtcagaaggcaaaaaagagagtaactccacagaagctccaaattctttatatgggtcaatgtccatgtcctaaagccacccaaggcacagcttggaggcttgaacagtaggacatgaacatgagatgattaggcagaggtgaaaaagttgcatggtgctggtgaacagaccaatttatgcctacagcctcctagtacaaagatcattaacctaatctcctcccccaactcctcccagtccttaaacaaacagtctttgaagtatgcctcaaggtcggtcgttgacattgctgagagtccaagagtcctcttatataagaccttgggcaagacctggtgggcgttcacggtggtctccatgcgacgtgcagaggtgaagcgaagtgcacacggtccggcagatgagaaggcacagacggggagaccgcgtaaagagaggtgcgccccgtggtcggccggaacggcagatgaagaaggggacggtagagacccaaacggccccgagatgggtcgtccgcgggattcagcgccgacgggacgtaaacaaaggacgtcccgcgcaggatccagttggcagcacaccctagcagccatggaaaggaggtgtatttccgagagagaacaacagagttgtccgttccgatcagtttcgctccagaccggctgcgagcaaaacaagctgctaggagttccgcagtatggatcggcagaggagccacaaaggttccacgcatgcggcgatggccaatagccaagccccatccagtgggggttgcgtcagcaaacacttggcagagacctgaccgttgccgggcaacggggtaaaggttcagatattgtttacacagaaaggccttgtaagttggcgagaaagtgaaagcctgcttagattgtatacatgcatataaaggcattaaggcaggatagccacattgtgtaaaaggggcagcaaagcccaaaagacccacaattctctgacatactttccaatcaataggtctatttacaggcagttttcgaaaacattgcttgatttttagtacaatatggtcttgcggtaaagtaccccaacttccaattacatatcccatgaagttaagggagtaaccccaacgtttggttttattagggttcaaatgtatacccaaagacaaaagaaaattggtaacagcggtaaaaagggactcaagatgttgtacagacttggcccccaataccacatcatccatataactgaaagccaaacagtgggggaaagccctacgaaccactgaacaaatggcactagtaaactgagccaggagaaacggactgaggcccactcccataggaatcttgcgaaagcccaggatgatgggatgggaatacaagtgcagtttccgtccgaaggttttgtacagcaacaagagggaaacatagaggtgccttgagcaggaatcgtgcaggtcttgcatggtcccgtgctggtagttgatgttcctggaagtagaggacaaacgggcaacataccttggtagtccagaagaaccaacaagaagatgaggcatagcagcaggatgaagaggaatatgataaaacgccgcagacacatccagcgatagccaggacaaattggaggacaagaggttggtgagtgattggaggttggggactgcgaattttggccaggacacgtgggtgctccccctagaaaattgagagaagtccaccacgagtctagactctgtggtattgtgaggattcttgtcaacaagaaaaaccccgcctgtaacacgagcaggggtcctaggaatcctgatgttgtgttctccatgttcggtgcagggtccccagtcctcgagaagattgacgatatgggagaggcagtagtcggaacagggtttactgttccggaactggagccaccagcaggaaagtataggccccttactctggggtgtagcagagcttggtggaatgtggtggag

SEQ ID NO: 5 - RNA, 19 nt, Artificial Sequence
  source: /note="Description of Artificial Sequence: Synthetic oligonucleotide"
ucgugguggacuucucuca

SEQ ID NO: 6 - RNA, 21 nt, Artificial Sequence
  source: /note="Description of Artificial Sequence: Synthetic oligonucleotide"
ugagagaaguccaccacgauu

SEQ ID NO: 7 - RNA, 21 nt, Artificial Sequence
  source: /note="Description of Artificial Sequence: Synthetic oligonucleotide"
gugcacuucgcuucaccucua

SEQ ID NO: 8 - RNA, 23 nt, Artificial Sequence
  source: /note="Description of Artificial Sequence: Synthetic oligonucleotide"
uagaggugaagcgaagugcacuu

SEQ ID NO: 9 - RNA, 21 nt, Artificial Sequence
  source: /note="Description of Artificial Sequence: Synthetic oligonucleotide"
cgugguggacuucucucaauu

SEQ ID NO: 10 - RNA, 23 nt, Artificial Sequence
  source: /note="Description of Artificial Sequence: Synthetic oligonucleotide"
aauugagagaaguccaccagcag

SEQ ID NO: 11 - RNA, 21 nt, Artificial Sequence
  source: /note="Description of Artificial Sequence: Synthetic oligonucleotide"
gguggacuucucucaauuuua

SEQ ID NO: 12 - RNA, 23 nt, Artificial Sequence
  source: /note="Description of Artificial Sequence: Synthetic oligonucleotide"
uaaaauugagagaaguccaccac

SEQ ID NO: 13 - RNA, 19 nt, Artificial Sequence
  source: /note="Description of Artificial Sequence: Synthetic oligonucleotide"
ucgugguggacuucucuca

SEQ ID NO: 14 - RNA, 21 nt, Artificial Sequence
  source: /note="Description of Artificial Sequence: Synthetic oligonucleotide"
ugagagaaguccaccacgauu

SEQ ID NO: 15 - RNA, 19 nt, Artificial Sequence
  source: /note="Description of Artificial Sequence: Synthetic oligonucleotide"
ucgugguggacuucucuca

SEQ ID NO: 16 - RNA, 21 nt, Artificial Sequence
  source: /note="Description of Artificial Sequence: Synthetic oligonucleotide"
ugagagaaguccaccacgauu

SEQ ID NO: 17 - RNA, 21 nt, Artificial Sequence
  source: /note="Description of Artificial Sequence: Synthetic oligonucleotide"
gugcacuucgcuucaccucua

SEQ ID NO: 18 - RNA, 23 nt, Artificial Sequence
  source: /note="Description of Artificial Sequence: Synthetic oligonucleotide"
uagaggugaagcgaagugcacuu

SEQ ID NO: 19 - RNA, 21 nt, Artificial Sequence
  source: /note="Description of Artificial Sequence: Synthetic oligonucleotide"
gugcacuucgcuucaccucua

SEQ ID NO: 20 - RNA, 23 nt, Artificial Sequence
  source: /note="Description of Artificial Sequence: Synthetic oligonucleotide"
uagaggugaagcgaagugcacuu

SEQ ID NO: 21 - RNA, 21 nt, Artificial Sequence
  source: /note="Description of Artificial Sequence: Synthetic oligonucleotide"
cgugguggacuucucucaauu

SEQ ID NO: 22 - RNA, 23 nt, Artificial Sequence
  source: /note="Description of Artificial Sequence: Synthetic oligonucleotide"
aauugagagaaguccaccagcag

SEQ ID NO: 23 - RNA, 21 nt, Artificial Sequence
  source: /note="Description of Artificial Sequence: Synthetic oligonucleotide"
cgugguggacuucucucaauu

SEQ ID NO: 24 - RNA, 23 nt, Artificial Sequence
  source: /note="Description of Artificial Sequence: Synthetic oligonucleotide"
aauugagagaaguccaccagcag

SEQ ID NO: 25 - RNA, 21 nt, Artificial Sequence
  source: /note="Description of Artificial Sequence: Synthetic oligonucleotide"
gguggacuucucucaauuuua

SEQ ID NO: 26 - RNA, 23 nt, Artificial Sequence
  source: /note="Description of Artificial Sequence: Synthetic oligonucleotide"
uaaaauugagagaaguccaccac

SEQ ID NO: 27 - RNA, 21 nt, Artificial Sequence
  source: /note="Description of Artificial Sequence: Synthetic oligonucleotide"
gguggacuucucucaauuuua

SEQ ID NO: 28 - RNA, 23 nt, Artificial Sequence
  source: /note="Description of Artificial Sequence: Synthetic oligonucleotide"
uaaaauugagagaaguccaccac

SEQ ID NO: 29 - DNA, 1678 bp, Hepatitis delta virus
atgggccgcagttcccgacgaggagcccgcaagtgggaggatcagccaccggaggggacacgatgccaaagagtgggggaaatctcgcgagggaaatcccaagaaggtcgagaagtctcaagagacgaggggggacccccgagacgctggagacgcccgggaacaaggaaacagaacaaggtacggtagaaaagagcgagcctcccgatacgagtttgccaggacctatcaagtttggagtcatccgggccctaaggtagaatagaacaccggggggtgatccaccaggagatgaacggagaaatcacctccagaggaccccttcagcgaacagaagagactcccctcgataggagcaaggccatagcgatggggggagatgctaggagtcggaggagaccgaagcgaggaggaaagcaaagaaagcaacggggctagcgagtggatgttccgccccccgagggggccgagtgaggcttatcccggggatcgggcgtcgcccccacatagcggaccccaggaccccttccgaacgagggggacggtccttgaactcccaggggacccatggagccgtgggaatccccagacctcccttctccacactccttcccccctgcggggcccccccataagatggcgagatctccactcattgggtccgtcgtccatctccttttcttacctttggccggcatggtcccagcctcctcgtcggcgccggccgggcaacattccgaggggaccgtccctcggtaatggcgaatgggacccagaaatctcctttgattcccaaagagaatcaggagaaaactggctctcccttagccatccgagtggacgtctgtcctccttcggatgcccaggtcggaccgcggggaggtggagatgccatgccgacccgaagaggaaaggaaggacacggacgcgaaccgtgagtggaaccctcgatcctttattggggggtacactcgaggagtggaaggcggggaggagggggctgagggctaacctacggaaattcctgagttcccctggtgtccaggccgtcccctctccgagtgaagggagactccgggactcctagcatgctggggacgaacccgcctccgggcgctcccctcggacctccgtcgagggggttcacatccccaacccgcgggccggctactcttctttcccttctctcgtcttcctcggtcaaccttcgaagttcctcttcttcctccctgctgaggtccttccctcccgaggagagctgcttcttcttgttctccagggccttccttcttcggtgatcccgtctctcctgttcggtgaaccctcccgggtgtttcctcttcctaggtccggagtcgacctccatctgatccgtcctggctctcttcgccgggggagctccctccccgtccttgtcttttcttattattcctcggatgtttcccagccaggggttgtcctcctcaagtctcttgatagtcttgttgaccttccggaggtccctctcgagctcctcctttcttcttcttgcatcgatccactttccgagtgtctcttctctccccttccggggtctcctcgaatcgggcaggctcatcctcgattgcgggcggcggtcctgagaactcttatcttcctgcttagaagaggagtctcctggacgccccgcccggtcggg

SEQ ID NO: 30 - DNA, 1678 bp, Hepatitis delta virus
cccgaccgggcggggcgtccaggagactcctcttctaagcaggaagataagagttctcaggaccgccgcccgcaatcgaggatgagcctgcccgattcgaggagaccccggaaggggagagaagagacactcggaaagtggatcgatgcaagaagaagaaaggaggagctcgagagggacctccggaaggtcaacaagactatcaagagacttgaggaggacaacccctggctgggaaacatccgaggaataataagaaaagacaaggacggggagggagctcccccggcgaagagagccaggacggatcagatggaggtcgactccggacctaggaagaggaaacacccgggagggttcaccgaacaggagagacgggatcaccgaagaaggaaggccctggagaacaagaagaagcagctctcctcgggagggaaggacctcagcagggaggaagaagaggaacttcgaaggttgaccgaggaagacgagagaagggaaagaagagtagccggcccgcgggttggggatgtgaaccccctcgacggaggtccgaggggagcgcccggaggcgggttcgtccccagcatgctaggagtcccggagtctcccttcactcggagaggggacggcctggacaccaggggaactcaggaatttccgtaggttagccctcagccccctcctccccgccttccactcctcgagtgtaccccccaataaaggatcgagggttccactcacggttcgcgtccgtgtccttcctttcctcttcgggtcggcatggcatctccacctccccgcggtccgacctgggcatccgaaggaggacagacgtccactcggatggctaagggagagccagttttctcctgattctctttgggaatcaaaggagatttctgggtcccattcgccattaccgagggacggtcccctcggaatgttgcccggccggcgccgacgaggaggctgggaccatgccggccaaaggtaagaaaaggagatggacgacggacccaatgagtggagatctcgccatcttatgggggggccccgcaggggggaaggagtgtggagaagggaggtctggggattcccacggctccatgggtcccctgggagttcaaggaccgtccccctcgttcggaaggggtcctggggtccgctatgtgggggcgacgcccgatccccgggataagcctcactcggccccctcggggggcggaacatccactcgctagccccgttgctttctttgctttcctcctcgcttcggtctcctccgactcctagcatctccccccatcgctatggccttgctcctatcgaggggagtctcttctgttcgctgaaggggtcctctggaggtgatttctccgttcatctcctggtggatcaccccccggtgttctattctaccttagggcccggatgactccaaacttgataggtcctggcaaactcgtatcgggaggctcgctcttttctaccgtaccttgttctgtttccttgttcccgggcgtctccagcgtctcgggggtcccccctcgtctcttgagacttctcgaccttcttgggatttccctcgcgagatttcccccactctttggcatcgtgtcccctccggtggctgatcctcccacttgcgggctcctcgtcgggaactgcggcccat

SEQ ID NO: 31 - DNA, 1683 bp, Hepatitis delta virus
atgagccgcatgccgggcgggagggacgaggtcggggaaggggagaccccgaggaggatctccagctaaagagtggaggaaatctcggaaagcttcccccaagaagaactgggacgctctcaagaaggaggagatttcccgaaagctggagactcgcggaatttcattcaagaagaaggtaacggagaaaggagcgggcctcccgatccgagtggtccacggcgtatcaagtttggagtcatccggccgaagggttgagatgacccacagtcgggtgatccaccaggagggtggaggagagaccacctccagaggaccccttcagcgaacagaagagctccctcctccggagagagaagaccatagcgatagggggagatgctaggagtaggaggcgaccgaagcgagggggaaagtaaagaaagcaacggggctagcgagtggatgttccaccccccagcggtgccgagtgaggcctatcccggggatcggtgaatcgtcccggaatggggactccgagggccccttccgaagtgacgggggggggtcactaggaacactggggtccagtggatccgtgggactaccctctccaccctcccaacacactccttcccccctgcggggcttccccataagatggcaggaacccactcattggggtccgctgttccattctttcttaccttgtggccggcatggtcccagcctcctcgctggcgccggctgggcaacattccgaggggaccgtccctcggtaatggcgaatgggacccagaactctctctagattcccagagagaatcgagagaaaactggctctcccttagccatccgagtggacgttcgtcctcctacggatgcccaggtcggaccgcgaggaggtggagatgccatgccgacccgaagaggaaagaagaactcggacgcgaaccgtgagtggaaccctgatcctttattggggagtacactcgaggagtggaaggcgttgttgggggggagatgggcttacctacgggaatccctgggtccccctgatgtccagtccctcccccgtccgagagaagggagactccggaactcctgccatttgagggacgaagccgccaccgggcgctcccctcggacctcctctggaggggttcacatccccaacccgcgggccggctactcttcttttcctttcctcgtcttcatcggtcagccttctgagttcctcttcttcctccttgctgaggatctttcctcccgcggagagctgcttcttcttgttctcgagggccttccttctgcggtgatcctccctctccttgtcggtgaacccgctcttgtgaggcctcttcccaggtccggagtcgacctccatctgatccgtccggggcctcttcgccgggggagccccctccccgtccttcccttttctgattattccgacgatgttccccagccagggattttcttcctcgagtttcttgatggtcttcctggtcttccggagatctttctcgagctcctccgcctttttccttgctgtgatccatttctcgagggtctcctcccttgttccccttcgtcctctcctcgtctcggattggctcattctcaggtcgggcgagggtcctcagttctctctattctttctttttgaaagaggagactgctggaccaaacgcccgaaccggg

SEQ ID NO: 32 - DNA, 1683 bp, Hepatitis delta virus
cccggttcgggcgtttggtccagcagtctcctctttcaaaaagaaagaatagagagaactgaggaccctcgcccgacctgagaatgagccaatccgagacgaggagaggacgaaggggaacaagggaggagaccctcgagaaatggatcacagcaaggaaaaaggcggaggagctcgagaaagatctccggaagaccaggaagaccatcaagaaactcgaggaagaaaatccctggctggggaacatcgtcggaataatcagaaaagggaaggacggggagggggctcccccggcgaagaggccccggacggatcagatggaggtcgactccggacctgggaagaggcctcacaagagcgggttcaccgacaaggagagggaggatcaccgcagaaggaaggccctcgagaacaagaagaagcagctctccgcgggaggaaagatcctcagcaaggaggaagaagaggaactcagaaggctgaccgatgaagacgaggaaaggaaaagaagagtagccggcccgcgggttggggatgtgaacccctccagaggaggtccgaggggagcgcccggtggcggcttcgtccctcaaatggcaggagttccggagtctcccttctctcggacgggggagggactggacatcagggggacccagggattcccgtaggtaagcccatctcccccccaacaacgccttccactcctcgagtgtactccccaataaaggatcagggttccactcacggttcgcgtccgagttcttctttcctcttcgggtcggcatggcatctccacctcctcgcggtccgacctgggcatccgtaggaggacgaacgtccactcggatggctaagggagagccagttttctctcgattctctctgggaatctagagagagttctgggtcccattcgccattaccgagggacggtcccctcggaatgttgcccagccggcgccagcgaggaggctgggaccatgccggccacaaggtaagaaagaatggaacagcggaccccaatgagtgggttcctgccatcttatggggaagccccgcaggggggaaggagtgtgttgggagggtggagagggtagtcccacggatccactggaccccagtgttcctagtgacccccccccgtcacttcggaaggggccctcggagtccccattccgggacgattcaccgatccccgggataggcctcactcggcaccgctggggggtggaacatccactcgctagccccgttgctttctttactttccccctcgcttcggtcgcctcctactcctagcatctccccctatcgctatggtcttctctctccggaggagggagctcttctgttcgctgaaggggtcctctggaggtggtctctcctccaccctcctggtggatcacccgactgtgggtcatctcaacccttcggccggatgactccaaacttgatacgccgtggaccactcggatcgggaggcccgctcctttctccgttaccttcttcttgaatgaaattccgcgagtctccagctttcgggaaatctcctccttcttgagagcgtcccagttcttcttgggggaagctttccgagatttcctccactctttagctggagatcctcctcggggtctccccttccccgacctcgtccctcccgcccggcatgcggctcat

SEQ ID NO: 33 - DNA, 1677 bp, Hepatitis delta virus
tgggccgcttccggcaagggggtccgaaatcgagagcgggggagaactcccgagagttgggagaagaaagagggcgaaaattctcggacggatcccccaagctcccaacagaggaagagaacaagatagaggagcccccacgacgctagcaaaccgtcgcgcactgggagaggagtgggcggaagatagaaacggagaccccggtccgaatgccaatcggcagcaaactcctctggagtcctccgggccgaaaggagaaaactaccggcggagggtgatccacccggagttgaacggacaagccacatccagaggaccccttcggcgaacagaagaccctggtaccgggagggaatagcccatagtacaaggggagatgctaggagtcggaggaagccagaacgactgagaaagcaaagagagcaacggggctagccaccgggtgttccatccatgggatcggtgccgagtgaggcttatcccgggggtgacgcctcggcccttccttagcatcggaatcccgggccccctcccaggaatgggaacagggggagatcgaccggggcccgcaggacccgatggagttcccccaccatcccttccggacgaaaactggtcccgataggggcacccacaataggatggcaaaaggggactctcgggtccgtcgttccatccttttcttacctcgtggccggcatggccccagcctcctcgctggcgccggctgggcaacgatccgagggagctactcctctcgagaatcggcaaatggggcccctcgctcgtatctccgagaggagacgagaaggaggtggatctccctttgccatccgagggagctacgctctccttacggatgcccaggtcggaccgcgaggaggtggagatcccatgccgacccgaagaggaaaggaggacacggacgacaaaccgtgagttctattgccctttattgttgggtgcaccctgggacccagtaatacccggggggaggcggggtaaacccatactatgggaactgctgggttcctcggatgtcgatcccctctcccgttcgggaaaagggggactccggaactccctgcaggctgggcacgaagcccccaccgggcgctcccctcggcgggccgtccattgggttcacacccccaggtcgcgggccggctgttcttctttctctttcgtcgtcatccctggccagcctccggagttcctcttcttcctcttggctgaggtgctttccccctccggccagttgcttcttcttgttctccagggccttccttcttctgtggtcccgcctctcctggtcggtgaaccccctggccttgggtttcctcccaggtccggaatcaacctccatggtttcctgcctcggcctcttcgccgggggcgctccgtcttcgtccttcttccttctcaacagtccaacgacgttccctagccaggggttctcatcctcaagtttcttgatcttcttgttggctcgccggagatccttctcgagctttcgcctgttcttcctttcctctacccactgttcgaggatctcctctctctccttcgaggtcagccttgcgacggtttggctcatcctgagaccggggagcttcgacgatctcttatctctcctaaggaggaaggagctctcgaacgcccccccggctcctcgga

SEQ ID NO: 34 - DNA, 1677 bp, Hepatitis delta virus
tccgaggagccgggggggcgttcgagagctccttcctccttaggagagataagagatcgtcgaagctccccggtctcaggatgagccaaaccgtcgcaaggctgacctcgaaggagagagaggagatcctcgaacagtgggtagaggaaaggaagaacaggcgaaagctcgagaaggatctccggcgagccaacaagaagatcaagaaacttgaggatgagaacccctggctagggaacgtcgttggactgttgagaaggaagaaggacgaagacggagcgcccccggcgaagaggccgaggcaggaaaccatggaggttgattccggacctgggaggaaacccaaggccagggggttcaccgaccaggagaggcgggaccacagaagaaggaaggccctggagaacaagaagaagcaactggccggagggggaaagcacctcagccaagaggaagaagaggaactccggaggctggccagggatgacgacgaaagagaaagaagaacagccggcccgcgacctgggggtgtgaacccaatggacggcccgccgaggggagcgcccggtgggggcttcgtgcccagcctgcagggagttccggagtcccccttttcccgaacgggagaggggatcgacatccgaggaacccagcagttcccatagtatgggtttaccccgcctccccccgggtattactgggtcccagggtgcacccaacaataaagggcaatagaactcacggtttgtcgtccgtgtcctcctttcctcttcgggtcggcatgggatctccacctcctcgcggtccgacctgggcatccgtaaggagagcgtagctccctcggatggcaaagggagatccacctccttctcgtctcctctcggagatacgagcgaggggccccatttgccgattctcgagaggagtagctccctcggatcgttgcccagccggcgccagcgaggaggctggggccatgccggccacgaggtaagaaaaggatggaacgacggacccgagagtccccttttgccatcctattgtgggtgcccctatcgggaccagttttcgtccggaagggatggtgggggaactccatcgggtcctgcgggccccggtcgatctccccctgttcccattcctgggagggggcccgggattccgatgctaaggaagggccgaggcgtcacccccgggataagcctcactcggcaccgatcccatggatggaacacccggtggctagccccgttgctctctttgctttctcagtcgttctggcttcctccgactcctagcatctccccttgtactatgggctattccctcccggtaccagggtcttctgttcgccgaaggggtcctctggatgtggcttgtccgttcaactccgggtggatcaccctccgccggtagttttctcctttcggcccggaggactccagaggagtttgctgccgattggcattcggaccggggtctccgtttctatcttccgcccactcctctcccagtgcgcgacggtttgctagcgtcgtgggggctcctctatcttgttctcttcctctgttgggagcttgggggatccgtccgagaattttcgccctctttcttctcccaactctcgggagttctcccccgctctcgatttcggacccccttgccggaagcggccca

SEQ ID NO: 35 - DNA, 1676 bp, Hepatitis delta virus
gatgggccacagtgccgacgaagaggccgcaggtgggaggatcagccaccggagagggacgcgatggtagagtggaggaaagttcggaaggggatcccaagaggatcactcgagattcaagaggtgaggagggatccccgagacgctggaggaacgccgggaaaaagaaaagaaggcaagagattggtagaaaagagcgagcctcccgatacgagtttgccaggacctatcaagtttggagtcatccggcccgtaggggagaatagaacaccggggggtgatccaccaggagaagtagcggagaacccacctccagaggaccccttctgcgaacagaaaagctcttccccctcgggagtagggccgtagcgatgggaggggatgctaggagttgggagaaaccgaagcgaggaggaaagcaaagaaagcaacggggctagcgagtggatgttcctctccccgaaggtcccgagtgaggcttatcccggggatcggcctccgctcctccatggtggatccaggacccccgaaaggaggggggtgggccttggacctccgggaaccatgggatccgtggagtacccgggccatccccttctccacactccttcccccctgcggggcccccccataagatggcgagaaatccactcatgggtccgtcgtccatctctttcttaccttttggccggcatggtcccagcctcctcgttggcgccggccgggcaacattccgaaggggaccgtccctcggtaatggcgaatgggacccagaactctccttagcttccaaaagagaagcaggagaaaactggctctcccttagccatccgagtggacgtccgtcctccttcggatgcccaggtcggaccccgaggaggtggagatgccatgccgacccgaagaggaagaagaggacacggacgcgaaccgtgagtggaaccctcgatcctttattggggggtacactcgaggagtggaaggcggggagaggggcgcccagggtcaacctacggaaatccctgtgttcctcggatgtccaggccgtcccctcttctagagaagggagactccggaactccttccatggttgggacgaagccgccaccgggcgctcccctcggagctccctcgagggggttcacatccccaacccgcgggccggctactcttctttcccttctctcgtcttcttcggttaacttccgaagttcctcttcctcctccctgctgaggacctttcccccggaggaaagctgctttttcttgttctccagggccttccttcttcggtggtcccgcctctcctgttcggtgaaccctcccgggtgtttcctcttcctaggtccggagtcgacctccatctgatccgtcctggctctcttcgccgggggagctccctccccatccttgtcctttcttattattcctcggatgttccccagccagggattgtcctcctcgagtctcttgagattcttgttgatcttccggagctccttctcgagttcctcctttcttcttcttccatcgatccacttcccgagtgtctcttctctccccctccggactctcctcgcatcggactggctcatcttcgaagagggcggacggtcccgagaacttctatcttcctgcttagaagaggagtctctgggacgcctccgcccactcgg

SEQ ID NO: 36 - DNA, 1676 bp, Hepatitis delta virus
ccgagtgggcggaggcgtcccagagactcctcttctaagcaggaagatagaagttctcgggaccgtccgccctcttcgaagatgagccagtccgatgcgaggagagtccggagggggagagaagagacactcgggaagtggatcgatggaagaagaagaaaggaggaactcgagaaggagctccggaagatcaacaagaatctcaagagactcgaggaggacaatccctggctggggaacatccgaggaataataagaaaggacaaggatggggagggagctcccccggcgaagagagccaggacggatcagatggaggtcgactccggacctaggaagaggaaacacccgggagggttcaccgaacaggagaggcgggaccaccgaagaaggaaggccctggagaacaagaaaaagcagctttcctccgggggaaaggtcctcagcagggaggaggaagaggaacttcggaagttaaccgaagaagacgagagaagggaaagaagagtagccggcccgcgggttggggatgtgaaccccctcgagggagctccgaggggagcgcccggtggcggcttcgtcccaaccatggaaggagttccggagtctcccttctctagaagaggggacggcctggacatccgaggaacacagggatttccgtaggttgaccctgggcgcccctctccccgccttccactcctcgagtgtaccccccaataaaggatcgagggttccactcacggttcgcgtccgtgtcctcttcttcctcttcgggtcggcatggcatctccacctcctcggggtccgacctgggcatccgaaggaggacggacgtccactcggatggctaagggagagccagttttctcctgcttctcttttggaagctaaggagagttctgggtcccattcgccattaccgagggacggtccccttcggaatgttgcccggccggcgccaacgaggaggctgggaccatgccggccaaaaggtaagaaagagatggacgacggacccatgagtggatttctcgccatcttatgggggggccccgcaggggggaaggagtgtggagaaggggatggcccgggtactccacggatcccatggttcccggaggtccaaggcccacccccctcctttcgggggtcctggatccaccatggaggagcggaggccgatccccgggataagcctcactcgggaccttcggggagaggaacatccactcgctagccccgttgctttctttgctttcctcctcgcttcggtttctcccaactcctagcatcccctcccatcgctacggccctactcccgagggggaagagcttttctgttcgcagaaggggtcctctggaggtgggttctccgctacttctcctggtggatcaccccccggtgttctattctcccctacgggccggatgactccaaacttgataggtcctggcaaactcgtatcgggaggctcgctcttttctaccaatctcttgccttcttttctttttcccggcgttcctccagcgtctcggggatccctcctcacctcttgaatctcgagtgatcctcttgggatccccttccgaactttcctccactctaccatcgcgtccctctccggtggctgatcctcccacctgcggcctcttcgtcggcactgtggcccatc

SEQ ID NO: 37 - DNA, 1689 bp, Hepatitis delta virus
atgggcctcgtgccgaggaaggtccggagaaggaggagtcaggaccccgaagggggctccaagcaaagagtgggagatcctcggggaatgtctcccaagaagaaccaggggacgacctcaagaagaggagytttcccaaacgccggtggagcatcggggaacaaggaaacaggagagggaacggtagaaaagagcagctcctcccaatccgaggggccccggactcctcagctctggagtcctccgccctgtgaagtcgaggttctccgcgcagggaggcagccacccggaaagaacggaaaaatcacctccagaggaccccttcarcgaacaaagaagcgagctgggacgccaggatgaggccmtagcgataggaggagatgctaggagtgggcggcgaccaaagcgaggagcgaaagaaagaaagcaacggggctagcgagtggatgttccgcctccccggggccccgagtgaggcttatcccggggaactcggccaagccccggaatgactggttcccacggctccacttccaaaaggaggagcgggtggacttggaacatgaggggccagtccagtccgtgggaattgccccggacctcccgatctccacactccttcccccctgcgggccccccaataagatggtaagaacccacccactggggtccgacgtccccaccctttcttacctgtggccggcatggtcccagcctcctcgctggcgccggctgggcaacattccgaggggaccgtccctcggtaatggcgaatgggacccagaactctctccaggttcccagagagaaccgagagaaaactggctctcccttagccatccgagtggacgtctgtcctccttcggatgcccaggtcggaccgcggggaggtggagatgccatgccgacccgaagaggaaagaaggactcggacgcgaacccgtgagtggaaccttaatcctttattggggagtacactcgaggagtggaaggcggggaggggggtcccgggtttacccacgggaactgctggtcccccctcacgtccagtccatctcccgtcctggagaagggagactcgggaacwccyagcattcgagggacaaagccgcccccgggcgctcccctcggaggtccctcgggtgggttcacatccccaacccgcgggccggctactcttctttccctctgctcgtcttccttggtcaacctcccgagttcctcttcttcctccttgctgaggaccttgcctcccgccgccagctgtttcttcttgttctcgagggccttccttcttcggtgatcccgtctttccctgtcggtgaagtctcccgcgcgagtcctcttcttagggccggaatcgacctccatctgatcygtccggggtctcttcgagggaggcgctccctccccgtccttcccttttcttattattccgacgatgttccccagccagggattrtcatcctcgagtttcttgatggtcctcctggccttccggagccttctctcgagatcctccgcatcttttcttgcttggacccacttctcgagggtttcctctcttcctcccctccgagacttcttcgattcggactggctcatcttcggaaaagggggcggcggcgtctgttctcttatcttcctgttgaaagaggagacagcttgccgcctgcccccagctccgag

SEQ ID NO: 38 - DNA, 1682 bp, Hepatitis delta virus
ctcggagctgggggcaggcggcaagctgtctcctctttcaacaggaagataagagaacagacgccgccgcccccttttccgaagatgagccagtccgaatcgaagaagtctcggaggggaggaagagaggaaaccctcgagaagtgggtccaagcaagaaaagatgcggaggatctcgagagaaggctccggaaggccaggaggaccatcaagaaactcgaggatgaaatccctggctggggaacatcgtcggaataataagaaaagggaaggacggggagggagcgcctccctcgaagagaccccggacgatcagatggaggtcgattccggccctaagaagaggactcgcgcgggagacttcaccgacagggaaagacgggatcaccgaagaaggaaggccctcgagaacaagaagaaacagctggcggcgggaggcaaggtcctcagcaaggaggaagaagaggaactcgggaggttgaccaaggaagacgagcagagggaaagaagagtagccggcccgcgggttggggatgtgaacccacccgagggacctccgaggggagcgcccgggggcggctttgtccctcgaatgctgggttcccgagtctcccttctccaggacgggagatggactggacgtgaggggggaccagcagttcccgtgggtaaacccgggacccccctccccgccttccactcctcgagtgtactccccaataaaggattaaggttccactcacgggttcgcgtccgagtccttctttcctcttcgggtcggcatggcatctccacctccccgcggtccgacctgggcatccgaaggaggacagacgtccactcggatggctaagggagagccagttttctctcggttctctctgggaacctggagagagttctgggtcccattcgccattaccgagggacggtcccctcggaatgttgcccagccggcgccagcgaggaggctgggaccatgccggccacaggtaagaaagggtggggacgtcggaccccagtgggtgggttcttaccatcttattggggggcccgcaggggggaaggagtgtggagatcgggaggtccggggcaattcccacggactggactggcccctcatgttccaagtccacccgctcctccttttggaagtggagccgtgggaaccagtcattccggggcttggccgagttccccgggataagcctcactcggggccccggggaggcggaacatccactcgctagccccgttgctttctttctttcgctcctcgctttggtcgccgcccactcctagcatctcctcctatcgctaggcctcatcctggcgtcccagctcgcttctttgttcgtgaaggggtcctctggaggtgatttttccgttctttccgggtggctgcctccctgcgcggagaacctcgacttcacagggcggaggactccagagctgaggagtccggggcccctcggattgggaggagctgctcttttctaccgttccctctcctgtttccttgttccccgatgctccaccggcgtttgggaaactcctcttcttgaggtcgtcccctggttcttcttgggagacattccccgaggatctcccactctttgcttggagcccccttcggggtcctgactcctccttctccggaccttcctcggcacgaggcccat

SEQ ID NO: 39 - DNA, 1683 bp, Hepatitis delta virus
atgggccaagttccgaacaaggatccgcggggaggacggatcacctcccgagaggggtaagtcggtaaagagcattggaacgtcggagatacaactcccaagaaggaaaaaagagaaagcaagaagcggaagaattccccataacgctagtgaaactctaggaagggaaaagaggtgcgatggaaaaagaggaggtgggcctcccgatccgagggtcccggtggccaagtttggaggacactccggcccgaagggttgaggatcccccagagggaggaagccacacggagtagaacagagaaatcacctccagaggaccccttcagcgaacagaggggcgcatcgcgagagggagtagaccatagcgatgggaggggatgctaggagttaggggagaccgaagcgaggaggaaagtaaagagagcagcggggctagtcggtgggtgttccgccccccgagaggggacgagtgaggcttatcccggggaattcgacttatcgtccccacatagcagagccccggaccccctttcaaagcgaccgaggggggtgactttgaacattggggaccagtggagccatgggatgctcctcccgattccgcccaaactccttcccccccaagggtcgcccaggaatggcgggaccccactctgcagggtccgcgttccatcctttcttacctgatggccggcatggtcccagcctcctcgctggcgccggctgggcaacattccgaggggaccgtcccctcggtaatggcgaatgggacgcacaaatctctctagcttcccagagagaagcgagagaaaagtggctctcccttggccatccgagtggacgtacgtcctccttcggatgcccaggtcggaccgcgaggaggtggagatgccatgccgacccgaagaggaaagaaggacgcgagacgcaaacctgtgagtggaaacccgctttattcactggggtcgacaactctggggagagaagggagggtcggctgggaagagtatatcccatgggaatccctggcttccccttatgtccagtccctccccggtccgagcgaagggggactccgggactccttgcatgctggggacgaagccgcccccgggcgctcccctcgatccaccttcgagggggttcacacccccaaccgacgggccggctattcttctttcccttttctcgtcttcctcggtcaacctcttaagttcctcttcctcctccctgctgaggctctttccccccgacgatagctgcttcctcttgttctcgagggccttccttcgtcggtgatcctgcctctccttgtcggtgaatcctcccctgagaggcctcttcctaggtccggcgtctatctccatctggtccatccggagcttcttcgccgggggtgccccctctccatccttatccttctttccgattattcctttgatgtttcccagccagggattgtcttcctctagtttcttgattttcttctttaacttccggaggtctctctcgagttcctctaacttctttcttccgctcacccactgctcgaggatgtcttccctccccccgcggtctttccttctttcggaccggctcatcttcgactagaggcgacggtcctcagtactcttactcttttctgtaaagaggagactgctggccctgtcgcccaagctcgag

SEQ ID NO: 40 - DNA, 1683 bp, Hepatitis delta virus
ctcgagcttgggcgacagggccagcagtctcctctttacagaaaagagtaagagtactgaggaccgtcgcctctagtcgaagatgagccggtccgaaagaaggaaagaccgcggggggagggaagacatcctcgagcagtgggtgagcggaagaaagaagttagaggaactcgagagagacctccggaagttaaagaagaaaatcaagaaactagaggaagacaatccctggctgggaaacatcaaaggaataatcggaaagaaggataaggatggagagggggcacccccggcgaagaagctccggatggaccagatggagatagacgccggacctaggaagaggcctctcaggggaggattcaccgacaaggagaggcaggatcaccgacgaaggaaggccctcgagaacaagaggaagcagctatcgtcggggggaaagagcctcagcagggaggaggaagaggaacttaagaggttgaccgaggaagacgagaaaagggaaagaagaatagccggcccgtcggttgggggtgtgaaccccctcgaaggtggatcgaggggagcgcccgggggcggcttcgtccccagcatgcaaggagtcccggagtcccccttcgctcggaccggggagggactggacataaggggaagccagggattcccatgggatatactcttcccagccgaccctcccttctctccccagagttgtcgaccccagtgaataaagcgggtttccactcacaggtttgcgtctcgcgtccttctttcctcttcgggtcggcatggcatctccacctcctcgcggtccgacctgggcatccgaaggaggacgtacgtccactcggatggccaagggagagccacttttctctcgcttctctctgggaagctagagagatttgtgcgtcccattcgccattaccgaggggacggtcccctcggaatgttgcccagccggcgccagcgaggaggctgggaccatgccggccatcaggtaagaaaggatggaacgcggaccctgcagagtggggtcccgccattcctgggcgacccttgggggggaaggagtttgggcggaatcgggaggagcatcccatggctccactggtccccaatgttcaaagtcacccccctcggtcgctttgaaagggggtccggggctctgctatgtggggacgataagtcgaattccccgggataagcctcactcgtcccctctcggggggcggaacacccaccgactagccccgctgctctctttactttcctcctcgcttcggtctcccctaactcctagcatcccctcccatcgctatggtctactccctctcgcgatgcgcccctctgttcgctgaaggggtcctctggaggtgatttctctgttctactccgtgtggcttcctccctctgggggatcctcaacccttcgggccggagtgtcctccaaacttggccaccgggaccctcggatcgggaggcccacctcctctttttccatcgcacctcttttcccttcctagagtttcactagcgttatggggaattcttccgcttcttgctttctcttttttccttcttgggagttgtatctccgacgttccaatgctctttaccgacttacccctctcgggaggtgatccgtcctccccgcggatccttgttcggaacttggcccat

SEQ ID NO: 41 - DNA, 1672 bp, Hepatitis delta virus
atgagccaagtccgacgaagagtccggagatgggagaggagagagacccccgaggaggcaaagtcgagagggcggagacactctgaggagaggactcccaagaggacaagaaggactcaagatccgggaacgaatccccaaaacgccggtaaagctcttggaatgaggaaaacgggcgggatggtagaaaagagcgagcctcccgattacgagattcccctgaacttattggatctggagactccgaccttaaggggtcaaaggtaggacagggaggcaatccaccaggagatttcggacaactcacctccagaggaccccttcagcgaacagaagagcctgtcccggtcgaattgtcccgtagcgataggaggagatgctaggagtagggagagaccggtgcgagagaggcaagacaagagagcagcggggctagcgagtggatgttccgccccccgttggctccgagtgaggcttatcccggggaatttggctawcttccccaactagccggtcccggatccccttccaratgaacggggggactccggcctctcggggaatcggcggctccatggtgaacccccgcagccccccactccacactccttccccccgcggggccccccatccaaagatggaactccacccctcagggttcgcyatcctacccttttcttacctttggccggcatggtcccagcctcctcgctggcgccggctgggcaacattccgaggggaccgtccctcggcaatggcgaatgggacccaagacctccaagattcccagagagaatctggaggtgactgggcactccctttgccatccgagtggacgttcgtcctccttcggatgcccaggtcggaccacggggaggtggagatgccatgccgacccgaagaggaaagaaggattcggacgcaaacctgtgagtggaagttcgctctttattggggggtacactcgaggagtggaaggcggggagggggggtcggactaggtccctatggaaactgtcggtctcctcggatgtcgagtccctctcccgttctggagaagggggactccgggacacctagcagttgaggaacgaagccgcccccgggcgctcccctcggtggtccctcgggagggttcacatccccaacccgcgggccggctattcttcttgctctttgctcgtcatcggcggtcaacttcctgagttcctcttcttcctccttgctgagggactttcctcctgcggacagctgcttcttcttgttctcgagggccttccttcgtcggtgagcccgtctctcctcgtcggtgaagcctcccttgttactctttttccctggtccggagtcgacctccatccgatctgttcggggtctcttcgccgggggagctccctccccagtcccgacctttccaattattcctttgatgtttcccagccagggattgtcgtcctcaagtttcttgatggtcttctttgtcttccggagcctcctctcgagttcttccgcgtcttcccttgctttgwcccacttcgaaagggtctcctcccttcccttccgggatctcttcgtatcggcgtggctcatctcggcagaggcgggcgatcctcagttctcttactcttttcttgaaagaggagactgctggacgctccgccgtgtccgagc

SEQ ID NO: 42 - DNA, 1668 bp, Hepatitis delta virus
gctcggacacggcggagcgtccagcagtctcctctttcaagaaaagagtaagagaactgaggatcgcccgcctctgccgagatgagccacgccgatacgaagagatcccggaagggaagggaggagaccctttcgaagtgggcaaagcaagggaagacgcggaagaactcgagaggaggctccggaagacaaagaagaccatcaagaaacttgaggacgacaatccctggctgggaaacatcaaaggaataattggaaaggtcgggactggggagggagctcccccggcgaagagaccccgaacagatcggatggaggtcgactccggaccagggaaaaagagtaacaagggaggcttcaccgacgaggagagacgggctcaccgacgaaggaaggccctcgagaacaagaagaagcagctgtccgcaggaggaaagtccctcagcaaggaggaagaagaggaactcaggaagttgaccgccgatgacgagcaaagagcaagaagaatagccggcccgcgggttggggatgtgaaccctcccgagggaccaccgaggggagcgcccgggggcggcttcgttcctcaactgctaggtgtcccggagtcccccttctccagaacgggagagggactcgacatccgaggagaccgacagtttccatagggacctagtccgaccccccctccccgccttccactcctcgagtgtaccccccaataaagagcgaacttccactcacaggtttgcgtccgaatccttctttcctcttcgggtcggcatggcatctccacctccccgtggtccgacctgggcatccgaaggaggacgaacgtccactcggatggcaaagggagtgcccagtcacctccagattctctctgggaatcttggaggtcttgggtcccattcgccattgccgagggacggtcccctcggaatgttgcccagccggcgccagcgaggaggctgggaccatgccggccaaaggtaagaaaagggtaggatgcgaaccctgaggggtggagttccatctttggatggggggccccgcggggggaaggagtgtggagtggggggctgcgggggttcaccatggagccgccgattccccgagaggccggagtccccccgttcattggaaggggatccgggaccggctagttggggaagtagccaaattccccgggataagcctcactcggagccaacggggggcggaacatccactcgctagccccgctgctctcttgtcttgcctctctcgcaccggtctctccctactcctagcatctcctcctatcgctacgggacaattcgaccgggacaggctcttctgttcgctgaaggggtcctctggaggtgagttgtccgaaatctcctggtggattgcctccctgtcctacctttgaccccttaaggtcggagtctccagatccaataagttcaggggaatctcgtaatcgggaggctcgctcttttctaccatcccgcccgttttcctcattccaagagctttaccggcgttttggggattcgttcccggatcttgagtccttcttgtcctcttgggagtcctctcctcagagtgtctccgccctctcgactttgcctcctcgggggtctctctcctctcccatctccggactcttcgtcggacttggctcat

SEQ ID NO: 43 - DNA, 1681 bp, Hepatitis delta virus
atgggccacgaaccgacgaagagtccgaaggtaggagaaggaggggcccccaaagggattcgaagctaaagagtggagacacacgagaagggaggtgtcccaagagggcgaggggaggtctcaaggagaggagggatccccgagacgctggagactcccggaacaaggaaagtggggataggaaggtagaaaagagcgagcctcccgatccgggattgccctgaacctatcgagtttggagtcctccgagcwyagggttgaatggagcgcaggagagggaagccaccaggagccggagacaagacacctccagaggaccccttcagcgaacagaagagtctatccccagatgagaggaccgtagccgagggggagatgctaggagtagggagagaccgaagcgaggaggaaagyaaagaaagcaacggggctagcaggagggtgttccgccccccggcggggccgagtgaggcttatcccggggaactcggaccagtcccggactgccggctccaggaatccgttccaaaggaccgagggtaggacttggagcaccggggattccargcaaacccatggtggactccgtcccccttctccacactccttccccccgcgggcccccccataaaatggagaaccccactctacagggtccgcgccctccccctttcttacctgtggccggcatggtcccagcctcctcgctggcgccggctgggcaacattccgaggggaccgtcccctcggtaatggcagatgggacccgagcttcccccggatcctctcttggggatcgagggggaaaaagccggcactcccttagccatccgagtggacgtccgtcctccttcggatgcccaggtcggaccacggggaggtggagatgccatgccgacccgaagaggaaagaaggagaccggacgcaaacctgtgagtggaactctcttcttttattggggggtacactcgaggagtggaaggcggggaggggggggcggactctgtccctatggaaattgctggtttcccctgacgtccagtccatccccgtgtctggagaacggagactccggaacacctagcatcctagggacaaatccgcccccgggcgctcccctcggacttcctccgggagggttcacacccccatcctgcgggccggctactcttctttcccttctctcgtcttcctcggtcaacttcctgagttcctcttcttcctccttgctgaggctcttccctccggaggatagttgcttcttcttgttctcgagggccttccttcttcggtgatccctcctctcctcgtcggtgaatccccccctgcgactcttcttccccggaccggagtcaacctccatctgatctgttcgggctctcttcgacgggggagctccctccccttccttcccctttcttattattccgaggatgttccccagccagggattgtcctcctcgagtttcttgatggtcctcctcgtcttccggatcttcctctcgaggtcctccagatctttccttgcttcgacccattttgtgagggtctcctcccgtcctccccttcggtttctcttcgaatcggactggctcatctcggcgagggcggcgatcctcagtgctcttactcttcacgatagaaagaggagactgctggatgccccgcccgggtccgagc

SEQ ID NO: 44 - DNA, 1677 bp, Hepatitis delta virus
gctcggacccgggcggggcatccagcagtctcctctttctatcgtgaagagtaagagcactgaggatcgccgccctcgccgagatgagccagtccgattcgaagagaaaccgaaggggaggacgggaggagaccctcacaaaatgggtcgaagcaaggaaagatctggaggacctcgagaggaagatccggaagacgaggaggaccatcaagaaactcgaggaggacaatccctggctggggaacatcctcggaataataagaaaggggaaggaaggggagggagctcccccgtcgaagagagcccgaacagatcagatggaggttgactccggtccggggaagaagagtcgcagggggggattcaccgacgaggagaggagggatcaccgaagaaggaaggccctcgagaacaagaagaagcaactatcctccggagggaagagcctcagcaaggaggaagaagaggaactcaggaagttgaccgaggaagacgagagaagggaaagaagagtagccggcccgcaggatgggggtgtgaaccctcccggaggaagtccgaggggagcgcccgggggcggatttgtccctaggatgctaggtgttccggagtctccgttctccagacacggggatggactggacgtcaggggaaaccagcaatttccatagggacagagtccgcccccccctccccgccttccactcctcgagtgtaccccccaataaaagaagagagttccactcacaggtttgcgtccggtctccttctttcctcttcgggtcggcatggcatctccacctccccgtggtccgacctgggcatccgaaggaggacggacgtccactcggatggctaagggagtgccggctttttccccctcgatccccaagagaggatccgggggaagctcgggtcccatctgccattaccgaggggacggtcccctcggaatgttgcccagccggcgccagcgaggaggctgggaccatgccggccacaggtaagaaagggggagggcgcggaccctgtagagtggggttctccattttatgggggggcccgcggggggaaggagtgtggagaagggggacggagtccaccatgggtttgctggaatccccggtgctccaagtcctaccctcggtcctttggaacggattcctggagccggcagtccgggactggtccgagttccccgggataagcctcactcggccccgccggggggcggaacaccctcctgctagccccgttgctttctttctttcctcctcgcttcggtctctccctactcctagcatctccccctcggctacggtcctctcatctggggatagactcttctgttcgctgaaggggtcctctggaggtgtcttgtctccggctcctggtggcttccctctcctgcgctccattcaaccctgctcggaggactccaaactcgataggttcagggcaatcccggatcgggaggctcgctcttttctaccttcctatccccactttccttgttccgggagtctccagcgtctcggggatccctcctctccttgagacctcccctcgccctcttgggacacctcccttctcgtgtgtctccactctttagcttcgaatccctttgggggcccctccttctcctaccttcggactcttcgtcggttcgtggcccat

SEQ ID NO: 45 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaaggaaggcccucgagtt

SEQ ID NO: 46 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucgagggccuuccuucgutt

SEQ ID NO: 47 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaaggaaggcccucgagatt

SEQ ID NO: 48 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucgagggccuuccuucgtt

SEQ ID NO: 49 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaggaaggcccucgagaatt

SEQ ID NO: 50 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucgagggccuuccuuctt

SEQ ID NO: 51 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaaggcccucgagaacatt

SEQ ID NO: 52 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguucucgagggccuuccutt

SEQ ID NO: 53 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaaggcccucgagaacaatt

SEQ ID NO: 54 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguucucgagggccuucctt

SEQ ID NO: 55 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaggcccucgagaacaagtt

SEQ ID NO: 56 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuguucucgagggccuuctt

SEQ ID NO: 57 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggugugaacccccucgatt

SEQ ID NO: 58 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaggggguucacacccctt

SEQ ID NO: 59 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggugugaacccccucgaatt

SEQ ID NO: 60 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgaggggguucacaccctt

SEQ ID NO: 61 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugugaacccccucgaagtt

SEQ ID NO: 62 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucgaggggguucacacctt

SEQ ID NO: 63 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaacccccucgaaggutt

SEQ ID NO: 64 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accuucgaggggguucacatt

SEQ ID NO: 65 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaucccuggcuggggaatt

SEQ ID NO: 66 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccccagccagggauuuutt

SEQ ID NO: 67 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucccuggcuggggaacatt

SEQ ID NO: 68 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuccccagccagggauutt

SEQ ID NO: 69 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucccuggcuggggaacautt

SEQ ID NO: 70 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguuccccagccagggautt

SEQ ID NO: 71 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagagcggguucaccgacatt

SEQ ID NO: 72 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucggugaacccgcucuutt

SEQ ID NO: 73 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagcggguucaccgacaatt

SEQ ID NO: 74 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugucggugaacccgcucutt

SEQ ID NO: 75 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagcggguucaccgacaagtt

SEQ ID NO: 76 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugucggugaacccgcuctt

SEQ ID NO: 77 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcggguucaccgacaaggatt

SEQ ID NO: 78 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuugucggugaacccgctt

SEQ ID NO: 79 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggguucaccgacaaggagtt

SEQ ID NO: 80 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccuugucggugaacccgtt

SEQ ID NO: 81 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggguucaccgacaaggagatt

SEQ ID NO: 82 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccuugucggugaaccctt

SEQ ID NO: 83 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguucaccgacaaggagagtt

SEQ ID NO: 84 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuccuugucggugaacctt

SEQ ID NO: 85 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggagggacuggacaucagtt

SEQ ID NO: 86 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugauguccagucccuccctt

SEQ ID NO: 87 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggguagaggaaaggaagaatt

SEQ ID NO: 88 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuuccuuuccucuaccctt

SEQ ID NO: 89 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggcgggaccacagaagatt

SEQ ID NO: 90 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucuguggucccgccuctt

SEQ ID NO: 91 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagaagaaggaaggcccutt

SEQ ID NO: 92 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggccuuccuucuucugutt

SEQ ID NO: 93 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagaagaggaacuccggatt

SEQ ID NO: 94 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccggaguuccucuucuuctt

SEQ ID NO: 95 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagggaugacgacgaaagatt

SEQ ID NO: 96 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuucgucgucaucccugtt

SEQ ID NO: 97 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggaugacgacgaaagagatt

SEQ ID NO: 98 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucuuucgucgucauccctt

SEQ ID NO: 99 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaugacgacgaaagagaatt

SEQ ID NO: 100 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucuuucgucgucaucctt

SEQ ID NO: 101 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugggggugugaacccaatt

SEQ ID NO: 102 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggguucacacccccaggtt

SEQ ID NO: 103 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugggggugugaacccaautt

SEQ ID NO: 104 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuggguucacacccccagtt

SEQ ID NO: 105 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuuucccgaacgggagatt

SEQ ID NO: 106 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucccguucgggaaaaggtt

SEQ ID NO: 107 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaacgggagaggggaucgatt

SEQ ID NO: 108 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgauccccucucccguuctt

SEQ ID NO: 109 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgggagaggggaucgacatt

SEQ ID NO: 110 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgauccccucucccgutt

SEQ ID NO: 111 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaggggaucgacauccgatt

SEQ ID NO: 112 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggaugucgauccccucutt

SEQ ID NO: 113 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggaucgacauccgaggatt

SEQ ID NO: 114 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccucggaugucgaucccctt

SEQ ID NO: 115 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggaucgacauccgaggaatt

SEQ ID NO: 116 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccucggaugucgauccctt

SEQ ID NO: 117 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauccgaggaacccagcatt

SEQ ID NO: 118 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuggguuccucggaugutt

SEQ ID NO: 119 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaacccagcaguucccautt

SEQ ID NO: 120 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augggaacugcuggguucctt

SEQ ID NO: 121 - RNA, 21 nt, Artificial Sequence
  source: /note="Description of Artificial Sequence: Synthetic oligonucleotide"
aguuauauggaugauguggua

SEQ ID NO: 122 - RNA, 21 nt, Artificial Sequence
  source: /note="Description of Artificial Sequence: Synthetic oligonucleotide"
ggaugugucugcggcguuuua

SEQ ID NO: 123 - RNA, 21 nt, Artificial Sequence
  source: /note="Description of Artificial Sequence: Synthetic oligonucleotide"
acucgugguggacuucucuca

SEQ ID NO: 124 - RNA, 21 nt, Artificial Sequence
  source: /note="Description of Artificial Sequence: Synthetic oligonucleotide"
acucgugguggacuucucuca

SEQ ID NO: 125 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 126 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 127 - RNA, 21 nt, Artificial Sequence
  source: /note="Description of Artificial Sequence: Synthetic oligonucleotide"
acucgugguggacuucucuca

SEQ ID NO: 128 - RNA, 19 nt, Artificial Sequence
  source: /note="Description of Artificial Sequence: Synthetic oligonucleotide"
ucgugguggacuucucuca

SEQ ID NO: 129 - RNA, 21 nt, Artificial Sequence
  source: /note="Description of Artificial Sequence: Synthetic oligonucleotide"
acucgugguggacuucucuca

SEQ ID NO: 130 - RNA, 21 nt, Artificial Sequence
  source: /note="Description of Artificial Sequence: Synthetic oligonucleotide"
acucgugguggacuucucuca

SEQ ID NO: 131 - RNA, 21 nt, Artificial Sequence
  source: /note="Description of Artificial Sequence: Synthetic oligonucleotide"
acucgugguggacuucucuca

SEQ ID NO: 132 - RNA, 21 nt, Artificial Sequence
  source: /note="Description of Artificial Sequence: Synthetic oligonucleotide"
acucgugguggacuucucuca

SEQ ID NO: 133 - RNA, 17 nt, Artificial Sequence
  source: /note="Description of Artificial Sequence: Synthetic oligonucleotide"
gugguggacuucucuca

SEQ ID NO: 134 - RNA, 21 nt, Artificial Sequence
  source: /note="Description of Artificial Sequence: Synthetic oligonucleotide"
acucgugguggacuucucuca

SEQ ID NO: 135 - RNA, 21 nt, Artificial Sequence
  source: /note="Description of Artificial Sequence: Synthetic oligonucleotide"
ucgugguggacuucucucauu

SEQ ID NO: 136 - RNA, 21 nt, Artificial Sequence
  source: /note="Description of Artificial Sequence: Synthetic oligonucleotide"
acucgugguggacuucucuca

SEQ ID NO: 137 - RNA, 21 nt, Artificial Sequence
  source: /note="Description of Artificial Sequence: Synthetic oligonucleotide"
acucgugguggacuucucuca

SEQ ID NO: 138 - RNA, 21 nt, Artificial Sequence
  source: /note="Description of Artificial Sequence: Synthetic oligonucleotide"
acucgugguggacuucucuca

SEQ ID NO: 139 - RNA, 21 nt, Artificial Sequence
  source: /note="Description of Artificial Sequence: Synthetic oligonucleotide"
acucgugguggacuucucuca

SEQ ID NO: 140 - RNA, 19 nt, Artificial Sequence
  source: /note="Description of Artificial Sequence: Synthetic oligonucleotide"
ucgugguggacuucucuca

SEQ ID NO: 141 - RNA, 21 nt, Artificial Sequence
  source: /note="Description of Artificial Sequence: Synthetic oligonucleotide"
acucgugguggacuucucuca

SEQ ID NO: 142 - RNA, 21 nt, Artificial Sequence
  source: /note="Description of Artificial Sequence: Synthetic oligonucleotide"
acucgugguggacuucucuca

SEQ ID NO: 143 - RNA, 21 nt, Artificial Sequence
  source: /note="Description of Artificial Sequence: Synthetic oligonucleotide"
acucgugguggacuucucuca

SEQ ID NO: 144 - RNA, 17 nt, Artificial Sequence
  source: /note="Description of Artificial Sequence: Synthetic oligonucleotide"
uauuuccuaggguacaa

SEQ ID NO: 145 - RNA, 21 nt, Artificial Sequence
  source: /note="Description of Artificial Sequence: Synthetic oligonucleotide"
acucgugguggacuucucuca

SEQ ID NO: 146 - RNA, 19 nt, Artificial Sequence
  source: /note="Description of Artificial Sequence: Synthetic oligonucleotide"
ucgugguggacuucucuca

SEQ ID NO: 147 - RNA, 21 nt, Artificial Sequence
  source: /note="Description of Artificial Sequence: Synthetic oligonucleotide"
acucgugguggacuucucuca

SEQ ID NO: 148 - RNA, 21 nt, Artificial Sequence
  source: /note="Description of Artificial Sequence: Synthetic oligonucleotide"
acucgugguggacuucucuca

SEQ ID NO: 149 - RNA, 21 nt, Artificial Sequence
  source: /note="Description of Artificial Sequence: Synthetic oligonucleotide"
acucgugguggacuucucuca

SEQ ID NO: 150 - RNA, 21 nt, Artificial Sequence
  source: /note="Description of Artificial Sequence: Synthetic oligonucleotide"
acucgugguggacuucucuca

SEQ ID NO: 151 - RNA, 21 nt, Artificial Sequence
  source: /note="Description of Artificial Sequence: Synthetic oligonucleotide"
acucgugguggacuucucuca

SEQ ID NO: 152 - RNA, 21 nt, Artificial Sequence
  source: /note="Description of Artificial Sequence: Synthetic oligonucleotide"
acucgugguggacuucucuca

SEQ ID NO: 153 - RNA, 21 nt, Artificial Sequence
  source: /note="Description of Artificial Sequence: Synthetic oligonucleotide"
acucgugguggacuucucuca

SEQ ID NO: 154 - RNA, 21 nt, Artificial Sequence
  source: /note="Description of Artificial Sequence: Synthetic oligonucleotide"
acucgugguggacuucucuca

SEQ ID NO: 155 - RNA, 21 nt, Artificial Sequence
  source: /note="Description of Artificial Sequence: Synthetic oligonucleotide"
acucgugguggacuucucuca

SEQ ID NO: 156 - RNA, 21 nt, Artificial Sequence
  source: /note="Description of Artificial Sequence: Synthetic oligonucleotide"
acucgugguggacuucucuca

SEQ ID NO: 157 - RNA, 21 nt, Artificial Sequence
  source: /note="Description of Artificial Sequence: Synthetic oligonucleotide"
acucgugguggacuucucuca

SEQ ID NO: 158 - RNA, 21 nt, Artificial Sequence
  source: /note="Description of Artificial Sequence: Synthetic oligonucleotide"
acucgugguggacuucucuca

SEQ ID NO: 159 - RNA, 21 nt, Artificial Sequence
  source: /note="Description of Artificial Sequence: Synthetic oligonucleotide"
acucgugguggacuucucuca

SEQ ID NO: 160 - RNA, 21 nt, Artificial Sequence
  source: /note="Description of Artificial Sequence: Synthetic oligonucleotide"
acucgugguggacuucucuca

SEQ ID NO: 161 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 162 - RNA, 21 nt, Artificial Sequence
  source: /note="Description of Artificial Sequence: Synthetic oligonucleotide"
acucgugguggacuucucuca

SEQ ID NO: 163 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 164 - RNA, 21 nt, Artificial Sequence
  source: /note="Description of Artificial Sequence: Synthetic oligonucleotide"
acucgugguggacuucucuca

SEQ ID NO: 165 - RNA, 21 nt, Artificial Sequence
  source: /note="Description of Artificial Sequence: Synthetic oligonucleotide"
acucgugguggacuucucuca

SEQ ID NO: 166 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 167 - RNA, 21 nt, Artificial Sequence
  source: /note="Description of Artificial Sequence: Synthetic oligonucleotide"
acucgugguggacuucucuca

SEQ ID NO: 168 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 169 - RNA, 21 nt, Artificial Sequence
  source: /note="Description of Artificial Sequence: Synthetic oligonucleotide"
acucgugguggacuucucuca

SEQ ID NO: 170 - RNA, 21 nt, Artificial Sequence
  source: /note="Description of Artificial Sequence: Synthetic oligonucleotide"
gugguggacuucucucaauuu

SEQ ID NO: 171 - RNA, 21 nt, Artificial Sequence
  source: /note="Description of Artificial Sequence: Synthetic oligonucleotide"
gugguggacuucucucaauuu

SEQ ID NO: 172 - RNA, 21 nt, Artificial Sequence
  source: /note="Description of Artificial Sequence: Synthetic oligonucleotide"
gugguggacuucucucaauuu

SEQ ID NO: 173 - RNA, 17 nt, Artificial Sequence
  source: /note="Description of Artificial Sequence: Synthetic oligonucleotide"
uggacuucucucaauuu

SEQ ID NO: 174 - RNA, 21 nt, Artificial Sequence
  source: /note="Description of Artificial Sequence: Synthetic oligonucleotide"
gugguggacuucucucaauuu

SEQ ID NO: 175 - RNA, 21 nt, Artificial Sequence
  source: /note="Description of Artificial Sequence: Synthetic oligonucleotide"
gguggacuucucucaauuuuu

SEQ ID NO: 176 - RNA, 21 nt, Artificial Sequence
  source: /note="Description of Artificial Sequence: Synthetic oligonucleotide"
gugguggacuucucucaauuu

SEQ ID NO: 177 - RNA, 21 nt, Artificial Sequence
  source: /note="Description of Artificial Sequence: Synthetic oligonucleotide"
gugguggacuucucucaauuu

SEQ ID NO: 178 - RNA, 21 nt, Artificial Sequence
  source: /note="Description of Artificial Sequence: Synthetic oligonucleotide"
gugguggacuucucucaauuu

SEQ ID NO: 179 - RNA, 19 nt, Artificial Sequence
  source: /note="Description of Artificial Sequence: Synthetic oligonucleotide"
gguggacuucucucaauuu

SEQ ID NO: 180 - RNA, 21 nt, Artificial Sequence
  source: /note="Description of Artificial Sequence: Synthetic oligonucleotide"
gugguggacuucucucaauuu

SEQ ID NO: 181 - RNA, 19 nt, Artificial Sequence
  source: /note="Description of Artificial Sequence: Synthetic oligonucleotide"
gguggacuucucucaauuu

SEQ ID NO: 182 - RNA, 21 nt, Artificial Sequence
  source: /note="Description of Artificial Sequence: Synthetic oligonucleotide"
gugguggacuucucucaauuu

SEQ ID NO: 183 - RNA, 21 nt, Artificial Sequence
  source: /note="Description of Artificial Sequence: Synthetic oligonucleotide"
gugguggacuucucucaauuu

SEQ ID NO: 184 - RNA, 17 nt, Artificial Sequence
  source: /note="Description of Artificial Sequence: Synthetic oligonucleotide"
uggacuucucucaauuu

SEQ ID NO: 185 - RNA, 21 nt, Artificial Sequence
  source: /note="Description of Artificial Sequence: Synthetic oligonucleotide"
gugguggacuucucucaauuu

SEQ ID NO: 186 - RNA, 19 nt, Artificial Sequence
  source: /note="Description of Artificial Sequence: Synthetic oligonucleotide"
gguggacuucucucaauuu

SEQ ID NO: 187 - RNA, 21 nt, Artificial Sequence
  source: /note="Description of Artificial Sequence: Synthetic oligonucleotide"
gugguggacuucucucaauuu

SEQ ID NO: 188 - RNA, 21 nt, Artificial Sequence
  source: /note="Description of Artificial Sequence: Synthetic oligonucleotide"
gugguggacuucucucaauuu

SEQ ID NO: 189 - RNA, 21 nt, Artificial Sequence
  source: /note="Description of Artificial Sequence: Synthetic oligonucleotide"
gugguggacuucucucaauuu

SEQ ID NO: 190 - RNA, 21 nt, Artificial Sequence
  source: /note="Description of Artificial Sequence: Synthetic oligonucleotide"
gugguggacuucucucaauuu

SEQ ID NO: 191 - RNA, 21 nt, Artificial Sequence
  source: /note="Description of Artificial Sequence: Synthetic oligonucleotide"
gugguggacuucucucaauuu

SEQ ID NO: 192 - RNA, 21 nt, Artificial Sequence
  source: /note="Description of Artificial Sequence: Synthetic oligonucleotide"
gugguggacuucucucaauuu

SEQ ID NO: 193 - RNA, 21 nt, Artificial Sequence
  source: /note="Description of Artificial Sequence: Synthetic oligonucleotide"
gugguggacuucucucaauuu

SEQ ID NO: 194 - RNA, 21 nt, Artificial Sequence
  source: /note="Description of Artificial Sequence: Synthetic oligonucleotide"
gugguggacuucucucaauuu

SEQ ID NO: 195 - RNA, 21 nt, Artificial Sequence
  source: /note="Description of Artificial Sequence: Synthetic oligonucleotide"
gugguggacuucucucaauuu

SEQ ID NO: 196 - RNA, 21 nt, Artificial Sequence
  source: /note="Description of Artificial Sequence: Synthetic oligonucleotide"
gugguggacuucucucaauuu

SEQ ID NO: 197 - RNA, 21 nt, Artificial Sequence
  source: /note="Description of Artificial Sequence: Synthetic oligonucleotide"
gugguggacuucucucaauuu

SEQ ID NO: 198 - RNA, 21 nt, Artificial Sequence
  source: /note="Description of Artificial Sequence: Synthetic oligonucleotide"
gugguggacuucucucaauuu

SEQ ID NO: 199 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugguggacttcucucaauuu

SEQ ID NO: 200 - RNA, 21 nt, Artificial Sequence
  source: /note="Description of Artificial Sequence: Synthetic oligonucleotide"
gugguggacuucucucaauuu

SEQ ID NO: 201 - RNA, 21 nt, Artificial Sequence
  source: /note="Description of Artificial Sequence: Synthetic oligonucleotide"
gugguggacuucucucaauuu

SEQ ID NO: 202 - RNA, 21 nt, Artificial Sequence
  source: /note="Description of Artificial Sequence: Synthetic oligonucleotide"
gugguggacuucucucaauuu

SEQ ID NO: 203 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugguggacutcucucaauuu

SEQ ID NO: 204 - RNA, 21 nt, Artificial Sequence
  source: /note="Description of Artificial Sequence: Synthetic oligonucleotide"
gugguggacuucucucaauuu

SEQ ID NO: 205 - RNA, 21 nt, Artificial Sequence
  source: /note="Description of Artificial Sequence: Synthetic oligonucleotide"
gugguggacuucucucaauuu

SEQ ID NO: 206 - RNA, 21 nt, Artificial Sequence
  source: /note="Description of Artificial Sequence: Synthetic oligonucleotide"
gugguggacuucucucaauuu

SEQ ID NO: 207 - RNA, 21 nt, Artificial Sequence
  source: /note="Description of Artificial Sequence: Synthetic oligonucleotide"
gugguggacuucucucaauuu

SEQ ID NO: 208 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugguggacutcucucaauuu

SEQ ID NO: 209 - RNA, 21 nt, Artificial Sequence
  source: /note="Description of Artificial Sequence: Synthetic oligonucleotide"
gugguggacuucucucaauuu

SEQ ID NO: 210 - RNA, 21 nt, Artificial Sequence
  source: /note="Description of Artificial Sequence: Synthetic oligonucleotide"
gugguggacuucucucaauuu

SEQ ID NO: 211 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugguggacutcucucaauuu

SEQ ID NO: 212 - RNA, 21 nt, Artificial Sequence
  source: /note="Description of Artificial Sequence: Synthetic oligonucleotide"
gugguggacuucucucaauuu

SEQ ID NO: 213 - RNA, 19 nt, Artificial Sequence
  source: /note="Description of Artificial Sequence: Synthetic oligonucleotide"
gguggacuucucucaauuu

SEQ ID NO: 214 - RNA, 21 nt, Artificial Sequence
  source: /note="Description of Artificial Sequence: Synthetic oligonucleotide"
gugguggacuucucucaauuu

SEQ ID NO: 215 - RNA, 21 nt, Artificial Sequence
  source: /note="Description of Artificial Sequence: Synthetic oligonucleotide"
gugcacuucgcuucaccucug

SEQ ID NO: 216 - RNA, 21 nt, Artificial Sequence
  source: /note="Description of Artificial Sequence: Synthetic oligonucleotide"
guugacaaaaauccucacaau

SEQ ID NO: 217 - RNA, 21 nt, Artificial Sequence
  source: /note="Description of Artificial Sequence: Synthetic oligonucleotide"
uguugacaaaaauccucacaa

SEQ ID NO: 218 - RNA, 21 nt, Artificial Sequence
  source: /note="Description of Artificial Sequence: Synthetic oligonucleotide"
gguggacuucucucaauuuua

SEQ ID NO: 219 - RNA, 21 nt, Artificial Sequence
  source: /note="Description of Artificial Sequence: Synthetic oligonucleotide"
ucuuuuggaguguggauucga

SEQ ID NO: 220 - RNA, 21 nt, Artificial Sequence
  source: /note="Description of Artificial Sequence: Synthetic oligonucleotide"
ucuuuuggaguguggauucga

SEQ ID NO: 221 - RNA, 21 nt, Artificial Sequence
  source: /note="Description of Artificial Sequence: Synthetic oligonucleotide"
acuguucaagccuccaagcua

SEQ ID NO: 222 - RNA, 21 nt, Artificial Sequence
  source: /note="Description of Artificial Sequence: Synthetic oligonucleotide"
ucugccgauccauacugcgga

SEQ ID NO: 223 - RNA, 21 nt, Artificial Sequence
  source: /note="Description of Artificial Sequence: Synthetic oligonucleotide"
augugucugcggcguuuuaua

SEQ ID NO: 224 - RNA, 21 nt, Artificial Sequence
  source: /note="Description of Artificial Sequence: Synthetic oligonucleotide"
ccccgucugugccuucucaua

SEQ ID NO: 225 - RNA, 21 nt, Artificial Sequence
  source: /note="Description of Artificial Sequence: Synthetic oligonucleotide"
gccuaaucaucucuuguucau

SEQ ID NO: 226 - RNA, 21 nt, Artificial Sequence
  source: /note="Description of Artificial Sequence: Synthetic oligonucleotide"
ucuagacucgugguggacuuc

SEQ ID NO: 227 - RNA, 21 nt, Artificial Sequence
  source: /note="Description of Artificial Sequence: Synthetic oligonucleotide"
cugccgauccauacugcggaa

SEQ ID NO: 228 - RNA, 21 nt, Artificial Sequence
  source: /note="Description of Artificial Sequence: Synthetic oligonucleotide"
uuuuucuuguugacaaaaaua

SEQ ID NO: 229 - RNA, 21 nt, Artificial Sequence
  source: /note="Description of Artificial Sequence: Synthetic oligonucleotide"
aucuucuuguugguucuucua

SEQ ID NO: 230 - RNA, 21 nt, Artificial Sequence
  source: /note="Description of Artificial Sequence: Synthetic oligonucleotide"
guuuuucuuguugacaaaaau

SEQ ID NO: 231 - RNA, 21 nt, Artificial Sequence
  source: /note="Description of Artificial Sequence: Synthetic oligonucleotide"
cugccuaaucaucucuuguua

SEQ ID NO: 232 - RNA, 21 nt, Artificial Sequence
  source: /note="Description of Artificial Sequence: Synthetic oligonucleotide"
uccucacaauaccacagagua

SEQ ID NO: 233 - RNA, 21 nt, Artificial Sequence
  source: /note="Description of Artificial Sequence: Synthetic oligonucleotide"
cuuguugacaaaaauccucaa

SEQ ID NO: 234 - RNA, 21 nt, Artificial Sequence
  source: /note="Description of Artificial Sequence: Synthetic oligonucleotide"
gcaacuuuuucaccucugccu

SEQ ID NO: 235 - RNA, 21 nt, Artificial Sequence
  source: /note="Description of Artificial Sequence: Synthetic oligonucleotide"
gggaacaagagcuacagcaua

SEQ ID NO: 236 - RNA, 21 nt, Artificial Sequence
  source: /note="Description of Artificial Sequence: Synthetic oligonucleotide"
cgugguggacuucucucaauu

SEQ ID NO: 237 - RNA, 21 nt, Artificial Sequence
  source: /note="Description of Artificial Sequence: Synthetic oligonucleotide"
cugcugcuaugccucaucuua

SEQ ID NO: 238 - RNA, 21 nt, Artificial Sequence
  source: /note="Description of Artificial Sequence: Synthetic oligonucleotide"
guuggaugugucugcggcguu

SEQ ID NO: 239 - RNA, 21 nt, Artificial Sequence
  source: /note="Description of Artificial Sequence: Synthetic oligonucleotide"
uucauccugcugcuaugccua

SEQ ID NO: 240 - RNA, 21 nt, Artificial Sequence
  source: /note="Description of Artificial Sequence: Synthetic oligonucleotide"
uucuuguugacaaaaauccua

SEQ ID NO: 241 - RNA, 21 nt, Artificial Sequence
  source: /note="Description of Artificial Sequence: Synthetic oligonucleotide"
uauauggaugaugugguauua

SEQ ID NO: 242 - RNA, 21 nt, Artificial Sequence
  source: /note="Description of Artificial Sequence: Synthetic oligonucleotide"
uucauccugcugcuaugccuc

SEQ ID NO: 243 - RNA, 21 nt, Artificial Sequence
  source: /note="Description of Artificial Sequence: Synthetic oligonucleotide"
gugcacuucgcuucaccucua

SEQ ID NO: 244 - RNA, 21 nt, Artificial Sequence
  source: /note="Description of Artificial Sequence: Synthetic oligonucleotide"
uugacaaaaauccucacaaua

SEQ ID NO: 245 - RNA, 21 nt, Artificial Sequence
  source: /note="Description of Artificial Sequence: Synthetic oligonucleotide"
aagccuccaagcugugccuua

SEQ ID NO: 246 - RNA, 21 nt, Artificial Sequence
  source: /note="Description of Artificial Sequence: Synthetic oligonucleotide"
ccucuucauccugcugcuaua

SEQ ID NO: 247 - RNA, 21 nt, Artificial Sequence
  source: /note="Description of Artificial Sequence: Synthetic oligonucleotide"
ccugcugcuaugccucaucuu

SEQ ID NO: 248 - RNA, 21 nt, Artificial Sequence
  source: /note="Description of Artificial Sequence: Synthetic oligonucleotide"
caucuucuuguugguucuucu

SEQ ID NO: 249 - RNA, 21 nt, Artificial Sequence
  source: /note="Description of Artificial Sequence: Synthetic oligonucleotide"
ccgucugugccuucucaucua

SEQ ID NO: 250 - RNA, 21 nt, Artificial Sequence
  source: /note="Description of Artificial Sequence: Synthetic oligonucleotide"
ccucaucuucuuguugguucu

SEQ ID NO: 251 - RNA, 21 nt, Artificial Sequence
  source: /note="Description of Artificial Sequence: Synthetic oligonucleotide"
ccaccaaaugccccuaucuua

SEQ ID NO: 252 - RNA, 21 nt, Artificial Sequence
  source: /note="Description of Artificial Sequence: Synthetic oligonucleotide"
gcuccucugccgauccauacu

SEQ ID NO: 253 - RNA, 21 nt, Artificial Sequence
  source: /note="Description of Artificial Sequence: Synthetic oligonucleotide"
guugacaaaaauccucacaau

SEQ ID NO: 254 - RNA, 21 nt, Artificial Sequence
  source: /note="Description of Artificial Sequence: Synthetic oligonucleotide"
uguugacaaaaauccucacaa

SEQ ID NO: 255 - RNA, 21 nt, Artificial Sequence
  source: /note="Description of Artificial Sequence: Synthetic oligonucleotide"
gguggacuucucucaauuuua

SEQ ID NO: 256 - RNA, 21 nt, Artificial Sequence
  source: /note="Description of Artificial Sequence: Synthetic oligonucleotide"
ucuuuuggaguguggauucga

SEQ ID NO: 257 - RNA, 21 nt, Artificial Sequence
  source: /note="Description of Artificial Sequence: Synthetic oligonucleotide"
ucuuuuggaguguggauucga

SEQ ID NO: 258 - RNA, 21 nt, Artificial Sequence
  source: /note="Description of Artificial Sequence: Synthetic oligonucleotide"
acuguucaagccuccaagcua

SEQ ID NO: 259 - RNA, 21 nt, Artificial Sequence
  source: /note="Description of Artificial Sequence: Synthetic oligonucleotide"
ucugccgauccauacugcgga

SEQ ID NO: 260 - RNA, 21 nt, Artificial Sequence
  source: /note="Description of Artificial Sequence: Synthetic oligonucleotide"
aguuauauggaugauguggua

SEQ ID NO: 261 - RNA, 21 nt, Artificial Sequence
  source: /note="Description of Artificial Sequence: Synthetic oligonucleotide"
augugucugcggcguuuuaua

SEQ ID NO: 262 - RNA, 21 nt, Artificial Sequence
  source: /note="Description of Artificial Sequence: Synthetic oligonucleotide"
ccccgucugugccuucucaua

SEQ ID NO: 263 - RNA, 21 nt, Artificial Sequence
  source: /note="Description of Artificial Sequence: Synthetic oligonucleotide"
gccuaaucaucucuuguucau

SEQ ID NO: 264 - RNA, 21 nt, Artificial Sequence
  source: /note="Description of Artificial Sequence: Synthetic oligonucleotide"
ucuagacucgugguggacuuc

SEQ ID NO: 265 - RNA, 21 nt, Artificial Sequence
  source: /note="Description of Artificial Sequence: Synthetic oligonucleotide"
cugccgauccauacugcggaa

SEQ ID NO: 266 - RNA, 21 nt, Artificial Sequence
  source: /note="Description of Artificial Sequence: Synthetic oligonucleotide"
aucuucuuguugguucuucua

SEQ ID NO: 267 - RNA, 21 nt, Artificial Sequence
  source: /note="Description of Artificial Sequence: Synthetic oligonucleotide"
uucucucaauuuucuagggga

SEQ ID NO: 268 - RNA, 21 nt, Artificial Sequence
  source: /note="Description of Artificial Sequence: Synthetic oligonucleotide"
acucgugguggacuucucuca

SEQ ID NO: 269 - RNA, 21 nt, Artificial Sequence
  source: /note="Description of Artificial Sequence: Synthetic oligonucleotide"
gugcacuucgcuucaccucug

SEQ ID NO: 270 - RNA, 21 nt, Artificial Sequence
  source: /note="Description of Artificial Sequence: Synthetic oligonucleotide"
guuuuucuuguugacaaaaau

SEQ ID NO: 271 - RNA, 21 nt, Artificial Sequence
  source: /note="Description of Artificial Sequence: Synthetic oligonucleotide"
cugccuaaucaucucuuguua

SEQ ID NO: 272 - RNA, 21 nt, Artificial Sequence
  source: /note="Description of Artificial Sequence: Synthetic oligonucleotide"
uccucacaauaccacagagua

SEQ ID NO: 273 - RNA, 21 nt, Artificial Sequence
  source: /note="Description of Artificial Sequence: Synthetic oligonucleotide"
cuuguugacaaaaauccucaa

SEQ ID NO: 274 - RNA, 21 nt, Artificial Sequence
  source: /note="Description of Artificial Sequence: Synthetic oligonucleotide"
gugguggacuucucucaauuu

SEQ ID NO: 275 - RNA, 21 nt, Artificial Sequence
  source: /note="Description of Artificial Sequence: Synthetic oligonucleotide"
gcaacuuuuucaccucugccu

SEQ ID NO: 276 - RNA, 21 nt, Artificial Sequence
  source: /note="Description of Artificial Sequence: Synthetic oligonucleotide"
gggaacaagagcuacagcaua

SEQ ID NO: 277 - RNA, 21 nt, Artificial Sequence
  source: /note="Description of Artificial Sequence: Synthetic oligonucleotide"
ucaucuucuuguugguucuua

SEQ ID NO: 278 - RNA, 21 nt, Artificial Sequence
  source: /note="Description of Artificial Sequence: Synthetic oligonucleotide"
cugcugcuaugccucaucuua

SEQ ID NO: 279 - RNA, 21 nt, Artificial Sequence
  source: /note="Description of Artificial Sequence: Synthetic oligonucleotide"
guuggaugugucugcggcguu

SEQ ID NO: 280 - RNA, 21 nt, Artificial Sequence
  source: /note="Description of Artificial Sequence: Synthetic oligonucleotide"
uucauccugcugcuaugccua

SEQ ID NO: 281 - RNA, 21 nt, Artificial Sequence
  source: /note="Description of Artificial Sequence: Synthetic oligonucleotide"
uucuuguugacaaaaauccua

SEQ ID NO: 282 - RNA, 21 nt, Artificial Sequence
  source: /note="Description of Artificial Sequence: Synthetic oligonucleotide"
ggaugugucugcggcguuuua

SEQ ID NO: 283 - RNA, 21 nt, Artificial Sequence
  source: /note="Description of Artificial Sequence: Synthetic oligonucleotide"
uauauggaugaugugguauua

SEQ ID NO: 284 - RNA, 21 nt, Artificial Sequence
  source: /note="Description of Artificial Sequence: Synthetic oligonucleotide"
uucauccugcugcuaugccuc

SEQ ID NO: 285 - RNA, 21 nt, Artificial Sequence
  source: /note="Description of Artificial Sequence: Synthetic oligonucleotide"
gugcacuucgcuucaccucua

SEQ ID NO: 286 - RNA, 21 nt, Artificial Sequence
  source: /note="Description of Artificial Sequence: Synthetic oligonucleotide"
uugacaaaaauccucacaaua

SEQ ID NO: 287 - RNA, 21 nt, Artificial Sequence
  source: /note="Description of Artificial Sequence: Synthetic oligonucleotide"
ccaaguguuugcugacgcaaa

SEQ ID NO: 288 - RNA, 21 nt, Artificial Sequence
  source: /note="Description of Artificial Sequence: Synthetic oligonucleotide"
ccaaguguuugcugacgcaaa

SEQ ID NO: 289 - RNA, 21 nt, Artificial Sequence
  source: /note="Description of Artificial Sequence: Synthetic oligonucleotide"
aagccuccaagcugugccuua

SEQ ID NO: 290 - RNA, 21 nt, Artificial Sequence
  source: /note="Description of Artificial Sequence: Synthetic oligonucleotide"
ccucuucauccugcugcuaua

SEQ ID NO: 291 - RNA, 21 nt, Artificial Sequence
  source: /note="Description of Artificial Sequence: Synthetic oligonucleotide"
ccugcugcuaugccucaucuu

SEQ ID NO: 292 - RNA, 21 nt, Artificial Sequence
  source: /note="Description of Artificial Sequence: Synthetic oligonucleotide"
caucuucuuguugguucuucu

SEQ ID NO: 293 - RNA, 21 nt, Artificial Sequence
  source: /note="Description of Artificial Sequence: Synthetic oligonucleotide"
ccgucugugccuucucaucua

SEQ ID NO: 294 - RNA, 21 nt, Artificial Sequence
  source: /note="Description of Artificial Sequence: Synthetic oligonucleotide"
ccucaucuucuuguugguucu

SEQ ID NO: 295 - RNA, 21 nt, Artificial Sequence
  source: /note="Description of Artificial Sequence: Synthetic oligonucleotide"
ccaccaaaugccccuaucuua

SEQ ID NO: 296 - RNA, 21 nt, Artificial Sequence
  source: /note="Description of Artificial Sequence: Synthetic oligonucleotide"
gcuccucugccgauccauacu

SEQ ID NO: 297 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggugtacuucucuca

SEQ ID NO: 298 - RNA, 21 nt, Artificial Sequence
  source: /note="Description of Artificial Sequence: Synthetic oligonucleotide"
acucgugguggacuucucuca

SEQ ID NO: 299 - RNA, 21 nt, Artificial Sequence
  source: /note="Description of Artificial Sequence: Synthetic oligonucleotide"
acucgugguggacuucucuca

SEQ ID NO: 300 - RNA, 21 nt, Artificial Sequence
  source: /note="Description of Artificial Sequence: Synthetic oligonucleotide"
acucgugguggacuucacuca

SEQ ID NO: 301 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtgtacuucacuca

SEQ ID NO: 302 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggugtacuucacuca

SEQ ID NO: 303 - RNA, 21 nt, Artificial Sequence
  source: /note="Description of Artificial Sequence: Synthetic oligonucleotide"
acucgugguggacuucucuca

SEQ ID NO: 304 - RNA, 21 nt, Artificial Sequence
  source: /note="Description of Artificial Sequence: Synthetic oligonucleotide"
acucgugguggacuucucuca

SEQ ID NO: 305 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuuctcuca

SEQ ID NO: 306 - RNA, 21 nt, Artificial Sequence
  source: /note="Description of Artificial Sequence: Synthetic oligonucleotide"
acucgugguggacuucucuca

SEQ ID NO: 307 - RNA, 21 nt, Artificial Sequence
  source: /note="Description of Artificial Sequence: Synthetic oligonucleotide"
acucgugguggacuucucuca

SEQ ID NO: 308 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtgtacuucacuca

SEQ ID NO: 309 - RNA, 21 nt, Artificial Sequence
  source: /note="Description of Artificial Sequence: Synthetic oligonucleotide"
acucgugguggacuucucuca

SEQ ID NO: 310 - RNA, 21 nt, Artificial Sequence
  source: /note="Description of Artificial Sequence: Synthetic oligonucleotide"
acucgugguggacuucucuca

SEQ ID NO: 311 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuucacuca

SEQ ID NO: 312 - RNA, 21 nt, Artificial Sequence
  source: /note="Description of Artificial Sequence: Synthetic oligonucleotide"
acucgugguggacuucacuca

SEQ ID NO: 313 - RNA, 21 nt, Artificial Sequence
  source: /note="Description of Artificial Sequence: Synthetic oligonucleotide"
acucgugguggacuucucuca

SEQ ID NO: 314 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuuctcuca

SEQ ID NO: 315 - RNA, 21 nt, Artificial Sequence
  source: /note="Description of Artificial Sequence: Synthetic oligonucleotide"
acucgugguggacuucucuca

SEQ ID NO: 316 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 317 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtgtacuucacuca

SEQ ID NO: 318 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuuctcuca

SEQ ID NO: 319 - RNA, 20 nt, Artificial Sequence
  source: /note="Description of Artificial Sequence: Synthetic oligonucleotide"
acucgugguggacuuccuca

SEQ ID NO: 320 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 321 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 322 - RNA, 21 nt, Artificial Sequence
  source: /note="Description of Artificial Sequence: Synthetic oligonucleotide"
acucgugguggacuucucuca

SEQ ID NO: 323 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuucacuca

SEQ ID NO: 324 - RNA, 21 nt, Artificial Sequence
  source: /note="Description of Artificial Sequence: Synthetic oligonucleotide"
acucgugguggacuucacuca

SEQ ID NO: 325 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuucacuca

SEQ ID NO: 326 - RNA, 21 nt, Artificial Sequence
  source: /note="Description of Artificial Sequence: Synthetic oligonucleotide"
acucgugguggacuucucuca

SEQ ID NO: 327 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 328 - RNA, 21 nt, Artificial Sequence
  source: /note="Description of Artificial Sequence: Synthetic oligonucleotide"
acucgugguggacuucacuca

SEQ ID NO: 329 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtgtacuucacuca

SEQ ID NO: 330 - RNA, 21 nt, Artificial Sequence
  source: /note="Description of Artificial Sequence: Synthetic oligonucleotide"
acucgugguggacuucccuca

SEQ ID NO: 331 - RNA, 21 nt, Artificial Sequence
  source: /note="Description of Artificial Sequence: Synthetic oligonucleotide"
acucgugguggacuucucuca

SEQ ID NO: 332 - RNA, 21 nt, Artificial Sequence
  source: /note="Description of Artificial Sequence: Synthetic oligonucleotide"
acucgugguggacuucucuca

SEQ ID NO: 333 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 334 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuuctcuca

SEQ ID NO: 335 - RNA, 21 nt, Artificial Sequence
  source: /note="Description of Artificial Sequence: Synthetic oligonucleotide"
acucgugguggacuucgcuca

SEQ ID NO: 336 - RNA, 21 nt, Artificial Sequence
  source: /note="Description of Artificial Sequence: Synthetic oligonucleotide"
acucgugguggacuucucuca

SEQ ID NO: 337 - RNA, 21 nt, Artificial Sequence
  source: /note="Description of Artificial Sequence: Synthetic oligonucleotide"
acucgugguggacuucucuca

SEQ ID NO: 338 - RNA, 21 nt, Artificial Sequence
  source: /note="Description of Artificial Sequence: Synthetic oligonucleotide"
acucgugguggacuucucuca

SEQ ID NO: 339 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuucacuca

SEQ ID NO: 340 - RNA, 21 nt, Artificial Sequence
  source: /note="Description of Artificial Sequence: Synthetic oligonucleotide"
aguuauauggaugauguggua

SEQ ID NO: 341 - RNA, 21 nt, Artificial Sequence
  source: /note="Description of Artificial Sequence: Synthetic oligonucleotide"
ggaugugucugcggcguuuua

SEQ ID NO: 342 - RNA, 21 nt, Artificial Sequence
  source: /note="Description of Artificial Sequence: Synthetic oligonucleotide"
acucgugguggacuucucuca

SEQ ID NO: 343 - RNA, 21 nt, Artificial Sequence
  source: /note="Description of Artificial Sequence: Synthetic oligonucleotide"
acucgugguggacuucucuca

SEQ ID NO: 344 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 345 - RNA, 21 nt, Artificial Sequence
  source: /note="Description of Artificial Sequence: Synthetic oligonucleotide"
acucgugguggacuucucuca

SEQ ID NO: 346 - RNA, 19 nt, Artificial Sequence
  source: /note="Description of Artificial Sequence: Synthetic oligonucleotide"
ucgugguggacuucucuca

SEQ ID NO: 347 - RNA, 21 nt, Artificial Sequence
  source: /note="Description of Artificial Sequence: Synthetic oligonucleotide"
acucgugguggacuucucuca

SEQ ID NO: 348 - RNA, 21 nt, Artificial Sequence
  source: /note="Description of Artificial Sequence: Synthetic oligonucleotide"
acucgugguggacuucucuca

SEQ ID NO: 349 - RNA, 21 nt, Artificial Sequence
  source: /note="Description of Artificial Sequence: Synthetic oligonucleotide"
acucgugguggacuucucuca

SEQ ID NO: 350 - RNA, 21 nt, Artificial Sequence
  source: /note="Description of Artificial Sequence: Synthetic oligonucleotide"
acucgugguggacuucucuca

SEQ ID NO: 351 - RNA, 17 nt, Artificial Sequence
  source: /note="Description of Artificial Sequence: Synthetic oligonucleotide"
gugguggacuucucuca

SEQ ID NO: 352 - RNA, 21 nt, Artificial Sequence
  source: /note="Description of Artificial Sequence: Synthetic oligonucleotide"
acucgugguggacuucucuca

SEQ ID NO: 353 - RNA, 21 nt, Artificial Sequence
  source: /note="Description of Artificial Sequence: Synthetic oligonucleotide"
ucgugguggacuucucucauu

SEQ ID NO: 354 - RNA, 21 nt, Artificial Sequence
  source: /note="Description of Artificial Sequence: Synthetic oligonucleotide"
acucgugguggacuucucuca

SEQ ID NO: 355 - RNA, 21 nt, Artificial Sequence
  source: /note="Description of Artificial Sequence: Synthetic oligonucleotide"
acucgugguggacuucucuca

SEQ ID NO: 356 - RNA, 21 nt, Artificial Sequence
  source: /note="Description of Artificial Sequence: Synthetic oligonucleotide"
acucgugguggacuucucuca

SEQ ID NO: 357 - RNA, 21 nt, Artificial Sequence
  source: /note="Description of Artificial Sequence: Synthetic oligonucleotide"
acucgugguggacuucucuca

SEQ ID NO: 358 - RNA, 19 nt, Artificial Sequence
  source: /note="Description of Artificial Sequence: Synthetic oligonucleotide"
ucgugguggacuucucuca

SEQ ID NO: 359 - RNA, 21 nt, Artificial Sequence
  source: /note="Description of Artificial Sequence: Synthetic oligonucleotide"
acucgugguggacuucucuca

SEQ ID NO: 360 - RNA, 21 nt, Artificial Sequence
  source: /note="Description of Artificial Sequence: Synthetic oligonucleotide"
acucgugguggacuucucuca

SEQ ID NO: 361 - RNA, 21 nt, Artificial Sequence
  source: /note="Description of Artificial Sequence: Synthetic oligonucleotide"
acucgugguggacuucucuca

SEQ ID NO: 362 - RNA, 17 nt, Artificial Sequence
  source: /note="Description of Artificial Sequence: Synthetic oligonucleotide"
uauuuccuaggguacaa

SEQ ID NO: 363 - RNA, 21 nt, Artificial Sequence
  source: /note="Description of Artificial Sequence: Synthetic oligonucleotide"
acucgugguggacuucucuca

SEQ ID NO: 364 - RNA, 19 nt, Artificial Sequence
  source: /note="Description of Artificial Sequence: Synthetic oligonucleotide"
ucgugguggacuucucuca

SEQ ID NO: 365 - RNA, 21 nt, Artificial Sequence
  source: /note="Description of Artificial Sequence: Synthetic oligonucleotide"
acucgugguggacuucucuca

SEQ ID NO: 366 - RNA, 21 nt, Artificial Sequence
  source: /note="Description of Artificial Sequence: Synthetic oligonucleotide"
acucgugguggacuucucuca

SEQ ID NO: 367 - RNA, 21 nt, Artificial Sequence
  source: /note="Description of Artificial Sequence: Synthetic oligonucleotide"
acucgugguggacuucucuca

SEQ ID NO: 368 - RNA, 21 nt, Artificial Sequence
  source: /note="Description of Artificial Sequence: Synthetic oligonucleotide"
acucgugguggacuucucuca

SEQ ID NO: 369 - RNA, 21 nt, Artificial Sequence
  source: /note="Description of Artificial Sequence: Synthetic oligonucleotide"
acucgugguggacuucucuca

SEQ ID NO: 370 - RNA, 21 nt, Artificial Sequence
  source: /note="Description of Artificial Sequence: Synthetic oligonucleotide"
acucgugguggacuucucuca

SEQ ID NO: 371 - RNA, 21 nt, Artificial Sequence
  source: /note="Description of Artificial Sequence: Synthetic oligonucleotide"
acucgugguggacuucucuca

SEQ ID NO: 372 - RNA, 21 nt, Artificial Sequence
  source: /note="Description of Artificial Sequence: Synthetic oligonucleotide"
acucgugguggacuucucuca

SEQ ID NO: 373 - RNA, 21 nt, Artificial Sequence
  source: /note="Description of Artificial Sequence: Synthetic oligonucleotide"
acucgugguggacuucucuca

SEQ ID NO: 374 - RNA, 21 nt, Artificial Sequence
  source: /note="Description of Artificial Sequence: Synthetic oligonucleotide"
acucgugguggacuucucuca

SEQ ID NO: 375 - RNA, 21 nt, Artificial Sequence
  source: /note="Description of Artificial Sequence: Synthetic oligonucleotide"
acucgugguggacuucucuca

SEQ ID NO: 376 - RNA, 21 nt, Artificial Sequence
  source: /note="Description of Artificial Sequence: Synthetic oligonucleotide"
acucgugguggacuucucuca

SEQ ID NO: 377 - RNA, 21 nt, Artificial Sequence
  source: /note="Description of Artificial Sequence: Synthetic oligonucleotide"
acucgugguggacuucucuca

SEQ ID NO: 378 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 379 - RNA, 21 nt, Artificial Sequence
  source: /note="Description of Artificial Sequence: Synthetic oligonucleotide"
acucgugguggacuucucuca

SEQ ID NO: 380 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 381 - RNA, 21 nt, Artificial Sequence
  source: /note="Description of Artificial Sequence: Synthetic oligonucleotide"
acucgugguggacuucucuca

SEQ ID NO: 382 - RNA, 21 nt, Artificial Sequence
  source: /note="Description of Artificial Sequence: Synthetic oligonucleotide"
acucgugguggacuucucuca

SEQ ID NO: 383 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 384 - RNA, 21 nt, Artificial Sequence
  source: /note="Description of Artificial Sequence: Synthetic oligonucleotide"
acucgugguggacuucucuca

SEQ ID NO: 385 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 386 - RNA, 21 nt, Artificial Sequence
  source: /note="Description of Artificial Sequence: Synthetic oligonucleotide"
acucgugguggacuucucuca

SEQ ID NO: 387 - RNA, 21 nt, Artificial Sequence
  source: /note="Description of Artificial Sequence: Synthetic oligonucleotide"
gugguggacuucucucaauuu

SEQ ID NO: 388 - RNA, 21 nt, Artificial Sequence
  source: /note="Description of Artificial Sequence: Synthetic oligonucleotide"
gugguggacuucucucaauuu

SEQ ID NO: 389 - RNA, 21 nt, Artificial Sequence
  source: /note="Description of Artificial Sequence: Synthetic oligonucleotide"
gugguggacuucucucaauuu

SEQ ID NO: 390 - RNA, 17 nt, Artificial Sequence
  source: /note="Description of Artificial Sequence: Synthetic oligonucleotide"
uggacuucucucaauuu

SEQ ID NO: 391 - RNA, 21 nt, Artificial Sequence
  source: /note="Description of Artificial Sequence: Synthetic oligonucleotide"
gugguggacuucucucaauuu

SEQ ID NO: 392 - RNA, 21 nt, Artificial Sequence
  source: /note="Description of Artificial Sequence: Synthetic oligonucleotide"
gguggacuucucucaauuuuu

SEQ ID NO: 393 - RNA, 21 nt, Artificial Sequence
  source: /note="Description of Artificial Sequence: Synthetic oligonucleotide"
gugguggacuucucucaauuu

SEQ ID NO: 394 - RNA, 21 nt, Artificial Sequence
  source: /note="Description of Artificial Sequence: Synthetic oligonucleotide"
gugguggacuucucucaauuu

SEQ ID NO: 395 - RNA, 21 nt, Artificial Sequence
  source: /note="Description of Artificial Sequence: Synthetic oligonucleotide"
gugguggacuucucucaauuu

SEQ ID NO: 396 - RNA, 19 nt, Artificial Sequence
  source: /note="Description of Artificial Sequence: Synthetic oligonucleotide"
gguggacuucucucaauuu

SEQ ID NO: 397 - RNA, 21 nt, Artificial Sequence
  source: /note="Description of Artificial Sequence: Synthetic oligonucleotide"
gugguggacuucucucaauuu

SEQ ID NO: 398 - RNA, 19 nt, Artificial Sequence
  source: /note="Description of Artificial Sequence: Synthetic oligonucleotide"
gguggacuucucucaauuu

SEQ ID NO: 399 - RNA, 21 nt, Artificial Sequence
  source: /note="Description of Artificial Sequence: Synthetic oligonucleotide"
gugguggacuucucucaauuu

SEQ ID NO: 400 - RNA, 21 nt, Artificial Sequence
  source: /note="Description of Artificial Sequence: Synthetic oligonucleotide"
gugguggacuucucucaauuu

SEQ ID NO: 401 - RNA, 17 nt, Artificial Sequence
  source: /note="Description of Artificial Sequence: Synthetic oligonucleotide"
uggacuucucucaauuu

SEQ ID NO: 402 - RNA, 21 nt, Artificial Sequence
  source: /note="Description of Artificial Sequence: Synthetic oligonucleotide"
gugguggacuucucucaauuu

SEQ ID NO: 403 - RNA, 19 nt, Artificial Sequence
  source: /note="Description of Artificial Sequence: Synthetic oligonucleotide"
gguggacuucucucaauuu

SEQ ID NO: 404 - RNA, 21 nt, Artificial Sequence
  source: /note="Description of Artificial Sequence: Synthetic oligonucleotide"
gugguggacuucucucaauuu

SEQ ID NO: 405 - RNA, 21 nt, Artificial Sequence
  source: /note="Description of Artificial Sequence: Synthetic oligonucleotide"
gugguggacuucucucaauuu

SEQ ID NO: 406 - RNA, 21 nt, Artificial Sequence
  source: /note="Description of Artificial Sequence: Synthetic oligonucleotide"
gugguggacuucucucaauuu

SEQ ID NO: 407 - RNA, 21 nt, Artificial Sequence
  source: /note="Description of Artificial Sequence: Synthetic oligonucleotide"
gugguggacuucucucaauuu

SEQ ID NO: 408 - RNA, 21 nt, Artificial Sequence
  source: /note="Description of Artificial Sequence: Synthetic oligonucleotide"
gugguggacuucucucaauuu

SEQ ID NO: 409 - RNA, 21 nt, Artificial Sequence
  source: /note="Description of Artificial Sequence: Synthetic oligonucleotide"
gugguggacuucucucaauuu

SEQ ID NO: 410 - RNA, 21 nt, Artificial Sequence
  source: /note="Description of Artificial Sequence: Synthetic oligonucleotide"
gugguggacuucucucaauuu

SEQ ID NO: 411 - RNA, 21 nt, Artificial Sequence
  source: /note="Description of Artificial Sequence: Synthetic oligonucleotide"
gugguggacuucucucaauuu

SEQ ID NO: 412 - RNA, 21 nt, Artificial Sequence
  source: /note="Description of Artificial Sequence: Synthetic oligonucleotide"
gugguggacuucucucaauuu

SEQ ID NO: 413 - RNA, 21 nt, Artificial Sequence
  source: /note="Description of Artificial Sequence: Synthetic oligonucleotide"
gugguggacuucucucaauuu

SEQ ID NO: 414 - RNA, 21 nt, Artificial Sequence
  source: /note="Description of Artificial Sequence: Synthetic oligonucleotide"
gugguggacuucucucaauuu

SEQ ID NO: 415 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugguggacttcucucaauuu

SEQ ID NO: 416 - RNA, 21 nt, Artificial Sequence
  source: /note="Description of Artificial Sequence: Synthetic oligonucleotide"
gugguggacuucucucaauuu

SEQ ID NO: 417 - RNA, 21 nt, Artificial Sequence
  source: /note="Description of Artificial Sequence: Synthetic oligonucleotide"
gugguggacuucucucaauuu

SEQ ID NO: 418 - RNA, 21 nt, Artificial Sequence
  source: /note="Description of Artificial Sequence: Synthetic oligonucleotide"
gugguggacuucucucaauuu

SEQ ID NO: 419 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugguggacutcucucaauuu

SEQ ID NO: 420 - RNA, 21 nt, Artificial Sequence
  source: /note="Description of Artificial Sequence: Synthetic oligonucleotide"
gugguggacuucucucaauuu

SEQ ID NO: 421 - RNA, 21 nt, Artificial Sequence
  source: /note="Description of Artificial Sequence: Synthetic oligonucleotide"
gugguggacuucucucaauuu

SEQ ID NO: 422 - RNA, 21 nt, Artificial Sequence
  source: /note="Description of Artificial Sequence: Synthetic oligonucleotide"
gugguggacuucucucaauuu

SEQ ID NO: 423 - RNA, 21 nt, Artificial Sequence
  source: /note="Description of Artificial Sequence: Synthetic oligonucleotide"
gugguggacuucucucaauuu

SEQ ID NO: 424 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugguggacutcucucaauuu

SEQ ID NO: 425 - RNA, 21 nt, Artificial Sequence
  source: /note="Description of Artificial Sequence: Synthetic oligonucleotide"
gugguggacuucucucaauuu

SEQ ID NO: 426 - RNA, 21 nt, Artificial Sequence
  source: /note="Description of Artificial Sequence: Synthetic oligonucleotide"
gugguggacuucucucaauuu

SEQ ID NO: 427 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugguggacutcucucaauuu

SEQ ID NO: 428 - RNA, 21 nt, Artificial Sequence
  source: /note="Description of Artificial Sequence: Synthetic oligonucleotide"
gugguggacuucucucaauuu

SEQ ID NO: 429 - RNA, 19 nt, Artificial Sequence
  source: /note="Description of Artificial Sequence: Synthetic oligonucleotide"
gguggacuucucucaauuu

SEQ ID NO: 430 - RNA, 21 nt, Artificial Sequence
  source: /note="Description of Artificial Sequence: Synthetic oligonucleotide"
gugguggacuucucucaauuu

SEQ ID NO: 431 - RNA, 21 nt, Artificial Sequence
  source: /note="Description of Artificial Sequence: Synthetic oligonucleotide"
gugcacuucgcuucaccucug

SEQ ID NO: 432 - RNA, 21 nt, Artificial Sequence
  source: /note="Description of Artificial Sequence: Synthetic oligonucleotide"
guugacaaaaauccucacaau

SEQ ID NO: 433 - RNA, 21 nt, Artificial Sequence
  source: /note="Description of Artificial Sequence: Synthetic oligonucleotide"
uguugacaaaaauccucacaa

SEQ ID NO: 434 - RNA, 21 nt, Artificial Sequence
  source: /note="Description of Artificial Sequence: Synthetic oligonucleotide"
gguggacuucucucaauuuua

SEQ ID NO: 435 - RNA, 21 nt, Artificial Sequence
  source: /note="Description of Artificial Sequence: Synthetic oligonucleotide"
ucuuuuggaguguggauucga

SEQ ID NO: 436 - RNA, 21 nt, Artificial Sequence
  source: /note="Description of Artificial Sequence: Synthetic oligonucleotide"
ucuuuuggaguguggauucga

SEQ ID NO: 437 - RNA, 21 nt, Artificial Sequence
  source: /note="Description of Artificial Sequence: Synthetic oligonucleotide"
acuguucaagccuccaagcua

SEQ ID NO: 438 - RNA, 21 nt, Artificial Sequence
  source: /note="Description of Artificial Sequence: Synthetic oligonucleotide"
ucugccgauccauacugcgga

SEQ ID NO: 439 - RNA, 21 nt, Artificial Sequence
  source: /note="Description of Artificial Sequence: Synthetic oligonucleotide"
augugucugcggcguuuuaua

SEQ ID NO: 440 - RNA, 21 nt, Artificial Sequence
  source: /note="Description of Artificial Sequence: Synthetic oligonucleotide"
ccccgucugugccuucucaua

SEQ ID NO: 441 - RNA, 21 nt, Artificial Sequence
  source: /note="Description of Artificial Sequence: Synthetic oligonucleotide"
gccuaaucaucucuuguucau

SEQ ID NO: 442 - RNA, 21 nt, Artificial Sequence
  source: /note="Description of Artificial Sequence: Synthetic oligonucleotide"
ucuagacucgugguggacuuc

SEQ ID NO: 443 - RNA, 21 nt, Artificial Sequence
  source: /note="Description of Artificial Sequence: Synthetic oligonucleotide"
cugccgauccauacugcggaa

SEQ ID NO: 444 - RNA, 21 nt, Artificial Sequence
  source: /note="Description of Artificial Sequence: Synthetic oligonucleotide"
uuuuucuuguugacaaaaaua

SEQ ID NO: 445 - RNA, 21 nt, Artificial Sequence
  source: /note="Description of Artificial Sequence: Synthetic oligonucleotide"
aucuucuuguugguucuucua

SEQ ID NO: 446 - RNA, 21 nt, Artificial Sequence
  source: /note="Description of Artificial Sequence: Synthetic oligonucleotide"
guuuuucuuguugacaaaaau

SEQ ID NO: 447 - RNA, 21 nt, Artificial Sequence
  source: /note="Description of Artificial Sequence: Synthetic oligonucleotide"
cugccuaaucaucucuuguua

SEQ ID NO: 448 - RNA, 21 nt, Artificial Sequence
  source: /note="Description of Artificial Sequence: Synthetic oligonucleotide"
uccucacaauaccacagagua

SEQ ID NO: 449 - RNA, 21 nt, Artificial Sequence
  source: /note="Description of Artificial Sequence: Synthetic oligonucleotide"
cuuguugacaaaaauccucaa

SEQ ID NO: 450 - RNA, 21 nt, Artificial Sequence
  source: /note="Description of Artificial Sequence: Synthetic oligonucleotide"
gcaacuuuuucaccucugccu

SEQ ID NO: 451 - RNA, 21 nt, Artificial Sequence
  source: /note="Description of Artificial Sequence: Synthetic oligonucleotide"
gggaacaagagcuacagcaua

SEQ ID NO: 452 - RNA, 21 nt, Artificial Sequence
  source: /note="Description of Artificial Sequence: Synthetic oligonucleotide"
cgugguggacuucucucaauu

SEQ ID NO: 453 - RNA, 21 nt, Artificial Sequence
  source: /note="Description of Artificial Sequence: Synthetic oligonucleotide"
cugcugcuaugccucaucuua

SEQ ID NO: 454 - RNA, 21 nt, Artificial Sequence
  source: /note="Description of Artificial Sequence: Synthetic oligonucleotide"
guuggaugugucugcggcguu

SEQ ID NO: 455 - RNA, 21 nt, Artificial Sequence
  source: /note="Description of Artificial Sequence: Synthetic oligonucleotide"
uucauccugcugcuaugccua

SEQ ID NO: 456 - RNA, 21 nt, Artificial Sequence
  source: /note="Description of Artificial Sequence: Synthetic oligonucleotide"
uucuuguugacaaaaauccua

SEQ ID NO: 457 - RNA, 21 nt, Artificial Sequence
  source: /note="Description of Artificial Sequence: Synthetic oligonucleotide"
uauauggaugaugugguauua

SEQ ID NO: 458 - RNA, 21 nt, Artificial Sequence
  source: /note="Description of Artificial Sequence: Synthetic oligonucleotide"
uucauccugcugcuaugccuc

SEQ ID NO: 459 - RNA, 21 nt, Artificial Sequence
  source: /note="Description of Artificial Sequence: Synthetic oligonucleotide"
gugcacuucgcuucaccucua

SEQ ID NO: 460 - RNA, 21 nt, Artificial Sequence
  source: /note="Description of Artificial Sequence: Synthetic oligonucleotide"
uugacaaaaauccucacaaua

SEQ ID NO: 461 - RNA, 21 nt, Artificial Sequence
  source: /note="Description of Artificial Sequence: Synthetic oligonucleotide"
aagccuccaagcugugccuua

SEQ ID NO: 462 - RNA, 21 nt, Artificial Sequence
  source: /note="Description of Artificial Sequence: Synthetic oligonucleotide"
ccucuucauccugcugcuaua

SEQ ID NO: 463 - RNA, 21 nt, Artificial Sequence
  source: /note="Description of Artificial Sequence: Synthetic oligonucleotide"
ccugcugcuaugccucaucuu

SEQ ID NO: 464 - RNA, 21 nt, Artificial Sequence
  source: /note="Description of Artificial Sequence: Synthetic oligonucleotide"
caucuucuuguugguucuucu

SEQ ID NO: 465 - RNA, 21 nt, Artificial Sequence
  source: /note="Description of Artificial Sequence: Synthetic oligonucleotide"
ccgucugugccuucucaucua

SEQ ID NO: 466 - RNA, 21 nt, Artificial Sequence
  source: /note="Description of Artificial Sequence: Synthetic oligonucleotide"
ccucaucuucuuguugguucu

SEQ ID NO: 467 - RNA, 21 nt, Artificial Sequence
  source: /note="Description of Artificial Sequence: Synthetic oligonucleotide"
ccaccaaaugccccuaucuua

SEQ ID NO: 468 - RNA, 21 nt, Artificial Sequence
  source: /note="Description of Artificial Sequence: Synthetic oligonucleotide"
gcuccucugccgauccauacu

SEQ ID NO: 469 - RNA, 21 nt, Artificial Sequence
  source: /note="Description of Artificial Sequence: Synthetic oligonucleotide"
guugacaaaaauccucacaau

SEQ ID NO: 470 - RNA, 21 nt, Artificial Sequence
  source: /note="Description of Artificial Sequence: Synthetic oligonucleotide"
uguugacaaaaauccucacaa

SEQ ID NO: 471 - RNA, 21 nt, Artificial Sequence
  source: /note="Description of Artificial Sequence: Synthetic oligonucleotide"
gguggacuucucucaauuuua

SEQ ID NO: 472 - RNA, 21 nt, Artificial Sequence
  source: /note="Description of Artificial Sequence: Synthetic oligonucleotide"
ucuuuuggaguguggauucga

SEQ ID NO: 473 - RNA, 21 nt, Artificial Sequence
  source: /note="Description of Artificial Sequence: Synthetic oligonucleotide"
ucuuuuggaguguggauucga

SEQ ID NO: 474 - RNA, 21 nt, Artificial Sequence
  source: /note="Description of Artificial Sequence: Synthetic oligonucleotide"
acuguucaagccuccaagcua

SEQ ID NO: 475 - RNA, 21 nt, Artificial Sequence
  source: /note="Description of Artificial Sequence: Synthetic oligonucleotide"
ucugccgauccauacugcgga

SEQ ID NO: 476 - RNA, 21 nt, Artificial Sequence
  source: /note="Description of Artificial Sequence: Synthetic oligonucleotide"
aguuauauggaugauguggua

SEQ ID NO: 477 - RNA, 21 nt, Artificial Sequence
  source: /note="Description of Artificial Sequence: Synthetic oligonucleotide"
augugucugcggcguuuuaua

SEQ ID NO: 478 - RNA, 21 nt, Artificial Sequence
  source: /note="Description of Artificial Sequence: Synthetic oligonucleotide"
ccccgucugugccuucucaua

SEQ ID NO: 479 - RNA, 21 nt, Artificial Sequence
  source: /note="Description of Artificial Sequence: Synthetic oligonucleotide"
gccuaaucaucucuuguucau

SEQ ID NO: 480 - RNA, 21 nt, Artificial Sequence
  source: /note="Description of Artificial Sequence: Synthetic oligonucleotide"
ucuagacucgugguggacuuc

SEQ ID NO: 481 - RNA, 21 nt, Artificial Sequence
  source: /note="Description of Artificial Sequence: Synthetic oligonucleotide"
cugccgauccauacugcggaa

SEQ ID NO: 482 - RNA, 21 nt, Artificial Sequence
  source: /note="Description of Artificial Sequence: Synthetic oligonucleotide"
aucuucuuguugguucuucua

SEQ ID NO: 483 - RNA, 21 nt, Artificial Sequence
  source: /note="Description of Artificial Sequence: Synthetic oligonucleotide"
uucucucaauuuucuagggga

SEQ ID NO: 484 - RNA, 21 nt, Artificial Sequence
  source: /note="Description of Artificial Sequence: Synthetic oligonucleotide"
acucgugguggacuucucuca

SEQ ID NO: 485 - RNA, 21 nt, Artificial Sequence
  source: /note="Description of Artificial Sequence: Synthetic oligonucleotide"
gugcacuucgcuucaccucug

SEQ ID NO: 486 - RNA, 21 nt, Artificial Sequence
  source: /note="Description of Artificial Sequence: Synthetic oligonucleotide"
guuuuucuuguugacaaaaau

SEQ ID NO: 487 - RNA, 21 nt, Artificial Sequence
  source: /note="Description of Artificial Sequence: Synthetic oligonucleotide"
cugccuaaucaucucuuguua

SEQ ID NO: 488 - RNA, 21 nt, Artificial Sequence
  source: /note="Description of Artificial Sequence: Synthetic oligonucleotide"
uccucacaauaccacagagua

SEQ ID NO: 489 - RNA, 21 nt, Artificial Sequence
  source: /note="Description of Artificial Sequence: Synthetic oligonucleotide"
cuuguugacaaaaauccucaa

SEQ ID NO: 490 - RNA, 21 nt, Artificial Sequence
  source: /note="Description of Artificial Sequence: Synthetic oligonucleotide"
gugguggacuucucucaauuu

SEQ ID NO: 491 - RNA, 21 nt, Artificial Sequence
  source: /note="Description of Artificial Sequence: Synthetic oligonucleotide"
gcaacuuuuucaccucugccu

SEQ ID NO: 492 - RNA, 21 nt, Artificial Sequence
  source: /note="Description of Artificial Sequence: Synthetic oligonucleotide"
gggaacaagagcuacagcaua

SEQ ID NO: 493 - RNA, 21 nt, Artificial Sequence
  source: /note="Description of Artificial Sequence: Synthetic oligonucleotide"
ucaucuucuuguugguucuua

SEQ ID NO: 494 - RNA, 21 nt, Artificial Sequence
  source: /note="Description of Artificial Sequence: Synthetic oligonucleotide"
cugcugcuaugccucaucuua

SEQ ID NO: 495 - RNA, 21 nt, Artificial Sequence
  source: /note="Description of Artificial Sequence: Synthetic oligonucleotide"
guuggaugugucugcggcguu

SEQ ID NO: 496 - RNA, 21 nt, Artificial Sequence
  source: /note="Description of Artificial Sequence: Synthetic oligonucleotide"
uucauccugcugcuaugccua

SEQ ID NO: 497 - RNA, 21 nt, Artificial Sequence
  source: /note="Description of Artificial Sequence: Synthetic oligonucleotide"
uucuuguugacaaaaauccua

SEQ ID NO: 498 - RNA, 21 nt, Artificial Sequence
  source: /note="Description of Artificial Sequence: Synthetic oligonucleotide"
ggaugugucugcggcguuuua

SEQ ID NO: 499 - RNA, 21 nt, Artificial Sequence
  source: /note="Description of Artificial Sequence: Synthetic oligonucleotide"
uauauggaugaugugguauua

SEQ ID NO: 500 - RNA, 21 nt, Artificial Sequence
  source: /note="Description of Artificial Sequence: Synthetic oligonucleotide"
uucauccugcugcuaugccuc

SEQ ID NO: 501 - RNA, 21 nt, Artificial Sequence
  source: /note="Description of Artificial Sequence: Synthetic oligonucleotide"
gugcacuucgcuucaccucua

SEQ ID NO: 502 - RNA, 21 nt, Artificial Sequence
  source: /note="Description of Artificial Sequence: Synthetic oligonucleotide"
uugacaaaaauccucacaaua

SEQ ID NO: 503 - RNA, 21 nt, Artificial Sequence
  source: /note="Description of Artificial Sequence: Synthetic oligonucleotide"
ccaaguguuugcugacgcaaa

SEQ ID NO: 504 - RNA, 21 nt, Artificial Sequence
  source: /note="Description of Artificial Sequence: Synthetic oligonucleotide"
ccaaguguuugcugacgcaaa

SEQ ID NO: 505 - RNA, 21 nt, Artificial Sequence
  source: /note="Description of Artificial Sequence: Synthetic oligonucleotide"
aagccuccaagcugugccuua

SEQ ID NO: 506 - RNA, 21 nt, Artificial Sequence
  source: /note="Description of Artificial Sequence: Synthetic oligonucleotide"
ccucuucauccugcugcuaua

SEQ ID NO: 507 - RNA, 21 nt, Artificial Sequence
  source: /note="Description of Artificial Sequence: Synthetic oligonucleotide"
ccugcugcuaugccucaucuu

SEQ ID NO: 508 - RNA, 21 nt, Artificial Sequence
  source: /note="Description of Artificial Sequence: Synthetic oligonucleotide"
caucuucuuguugguucuucu

SEQ ID NO: 509 - RNA, 21 nt, Artificial Sequence
  source: /note="Description of Artificial Sequence: Synthetic oligonucleotide"
ccgucugugccuucucaucua

SEQ ID NO: 510 - RNA, 21 nt, Artificial Sequence
  source: /note="Description of Artificial Sequence: Synthetic oligonucleotide"
ccucaucuucuuguugguucu

SEQ ID NO: 511 - RNA, 21 nt, Artificial Sequence
  source: /note="Description of Artificial Sequence: Synthetic oligonucleotide"
ccaccaaaugccccuaucuua

SEQ ID NO: 512 - RNA, 21 nt, Artificial Sequence
  source: /note="Description of Artificial Sequence: Synthetic oligonucleotide"
gcuccucugccgauccauacu

SEQ ID NO: 513 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggugtacuucucuca

SEQ ID NO: 514 - RNA, 21 nt, Artificial Sequence
  source: /note="Description of Artificial Sequence: Synthetic oligonucleotide"
acucgugguggacuucucuca

SEQ ID NO: 515 - RNA, 21 nt, Artificial Sequence
  source: /note="Description of Artificial Sequence: Synthetic oligonucleotide"
acucgugguggacuucucuca

SEQ ID NO: 516 - RNA, 21 nt, Artificial Sequence
  source: /note="Description of Artificial Sequence: Synthetic oligonucleotide"
acucgugguggacuucacuca

SEQ ID NO: 517 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtgtacuucacuca

SEQ ID NO: 518 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggugtacuucacuca

SEQ ID NO: 519 - RNA, 21 nt, Artificial Sequence
  source: /note="Description of Artificial Sequence: Synthetic oligonucleotide"
acucgugguggacuucucuca

SEQ ID NO: 520 - RNA, 21 nt, Artificial Sequence
  source: /note="Description of Artificial Sequence: Synthetic oligonucleotide"
acucgugguggacuucucuca

SEQ ID NO: 521 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuuctcuca

SEQ ID NO: 522 - RNA, 21 nt, Artificial Sequence
  source: /note="Description of Artificial Sequence: Synthetic oligonucleotide"
acucgugguggacuucucuca

SEQ ID NO: 523 - RNA, 21 nt, Artificial Sequence
  source: /note="Description of Artificial Sequence: Synthetic oligonucleotide"
acucgugguggacuucucuca

SEQ ID NO: 524 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtgtacuucacuca

SEQ ID NO: 525 - RNA, 21 nt, Artificial Sequence
  source: /note="Description of Artificial Sequence: Synthetic oligonucleotide"
acucgugguggacuucucuca

SEQ ID NO: 526 - RNA, 21 nt, Artificial Sequence
  source: /note="Description of Artificial Sequence: Synthetic oligonucleotide"
acucgugguggacuucucuca

SEQ ID NO: 527 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuucacuca

SEQ ID NO: 528 - RNA, 21 nt, Artificial Sequence
  source: /note="Description of Artificial Sequence: Synthetic oligonucleotide"
acucgugguggacuucacuca

SEQ ID NO: 529 - RNA, 21 nt, Artificial Sequence
  source: /note="Description of Artificial Sequence: Synthetic oligonucleotide"
acucgugguggacuucucuca

SEQ ID NO: 530 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuuctcuca

SEQ ID NO: 531 - RNA, 21 nt, Artificial Sequence
  source: /note="Description of Artificial Sequence: Synthetic oligonucleotide"
acucgugguggacuucucuca

SEQ ID NO: 532 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 533 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtgtacuucacuca

SEQ ID NO: 534 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuuctcuca

SEQ ID NO: 535 - RNA, 20 nt, Artificial Sequence
  source: /note="Description of Artificial Sequence: Synthetic oligonucleotide"
acucgugguggacuuccuca

SEQ ID NO: 536 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 537 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 538 - RNA, 21 nt, Artificial Sequence
  source: /note="Description of Artificial Sequence: Synthetic oligonucleotide"
acucgugguggacuucucuca

SEQ ID NO: 539 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuucacuca

SEQ ID NO: 540 - RNA, 21 nt, Artificial Sequence
  source: /note="Description of Artificial Sequence: Synthetic oligonucleotide"
acucgugguggacuucacuca

SEQ ID NO: 541 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuucacuca

SEQ ID NO: 542 - RNA, 21 nt, Artificial Sequence
  source: /note="Description of Artificial Sequence: Synthetic oligonucleotide"
acucgugguggacuucucuca

SEQ ID NO: 543 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 544 - RNA, 21 nt, Artificial Sequence
  source: /note="Description of Artificial Sequence: Synthetic oligonucleotide"
acucgugguggacuucacuca

SEQ ID NO: 545 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtgtacuucacuca

SEQ ID NO: 546 - RNA, 21 nt, Artificial Sequence
  source: /note="Description of Artificial Sequence: Synthetic oligonucleotide"
acucgugguggacuucccuca

SEQ ID NO: 547 - RNA, 21 nt, Artificial Sequence
  source: /note="Description of Artificial Sequence: Synthetic oligonucleotide"
acucgugguggacuucucuca

SEQ ID NO: 548 - RNA, 21 nt, Artificial Sequence
  source: /note="Description of Artificial Sequence: Synthetic oligonucleotide"
acucgugguggacuucucuca

SEQ ID NO: 549 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 550 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuuctcuca

SEQ ID NO: 551 - RNA, 21 nt, Artificial Sequence
  source: /note="Description of Artificial Sequence: Synthetic oligonucleotide"
acucgugguggacuucgcuca

SEQ ID NO: 552 - RNA, 21 nt, Artificial Sequence
  source: /note="Description of Artificial Sequence: Synthetic oligonucleotide"
acucgugguggacuucucuca

SEQ ID NO: 553 - RNA, 21 nt, Artificial Sequence
  source: /note="Description of Artificial Sequence: Synthetic oligonucleotide"
acucgugguggacuucucuca

SEQ ID NO: 554 - RNA, 21 nt, Artificial Sequence
  source: /note="Description of Artificial Sequence: Synthetic oligonucleotide"
acucgugguggacuucucuca

SEQ ID NO: 555 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuucacuca

SEQ ID NO: 556 - RNA, 23 nt, Artificial Sequence
  source: /note="Description of Artificial Sequence: Synthetic oligonucleotide"
uaccacaucauccauauaacuga

SEQ ID NO: 557 - RNA, 23 nt, Artificial Sequence
  source: /note="Description of Artificial Sequence: Synthetic oligonucleotide"
uaaaacgccgcagacacauccag

SEQ ID NO: 558 - RNA, 23 nt, Artificial Sequence
  source: /note="Description of Artificial Sequence: Synthetic oligonucleotide"
ugagagaaguccaccacgagucu

SEQ ID NO: 559 - RNA, 23 nt, Artificial Sequence
  source: /note="Description of Artificial Sequence: Synthetic oligonucleotide"
ugagagaaguccaccacgagucu

SEQ ID NO: 560 - RNA, 23 nt, Artificial Sequence
  source: /note="Description of Artificial Sequence: Synthetic oligonucleotide"
ugagagaaguccaccacgagucu

SEQ ID NO: 561 - RNA, 23 nt, Artificial Sequence
  source: /note="Description of Artificial Sequence: Synthetic oligonucleotide"
ugagagaaguccaccacgagucu

SEQ ID NO: 562 - RNA, 23 nt, Artificial Sequence
  source: /note="Description of Artificial Sequence: Synthetic oligonucleotide"
ugagagaaguccaccacgagucu

SEQ ID NO: 563 - RNA, 21 nt, Artificial Sequence
  source: /note="Description of Artificial Sequence: Synthetic oligonucleotide"
ugagagaaguccaccacgagu

SEQ ID NO: 564 - RNA, 23 nt, Artificial Sequence
  source: /note="Description of Artificial Sequence: Synthetic oligonucleotide"
ugagagaaguccaccacgagucu

SEQ ID NO: 565 - RNA, 23 nt, Artificial Sequence
  source: /note="Description of Artificial Sequence: Synthetic oligonucleotide"
ugagagaaguccaccacgagucu

SEQ ID NO: 566 - RNA, 23 nt, Artificial Sequence
  source: /note="Description of Artificial Sequence: Synthetic oligonucleotide"
ugagagaaguccaccacgagucu

SEQ ID NO: 567 - RNA, 23 nt, Artificial Sequence
  source: /note="Description of Artificial Sequence: Synthetic oligonucleotide"
ugagagaaguccaccacgagucu

SEQ ID NO: 568 - RNA, 19 nt, Artificial Sequence
  source: /note="Description of Artificial Sequence: Synthetic oligonucleotide"
ugagagaaguccaccacga

SEQ ID NO: 569 - RNA, 23 nt, Artificial Sequence
  source: /note="Description of Artificial Sequence: Synthetic oligonucleotide"
ugagagaaguccaccacgagucu

SEQ ID NO: 570 - RNA, 21 nt, Artificial Sequence
  source: /note="Description of Artificial Sequence: Synthetic oligonucleotide"
ugagagaaguccaccacgauu

SEQ ID NO: 571 - RNA, 23 nt, Artificial Sequence
  source: /note="Description of Artificial Sequence: Synthetic oligonucleotide"
ugagagaaguccaccacgagucu

SEQ ID NO: 572 - RNA, 23 nt, Artificial Sequence
  source: /note="Description of Artificial Sequence: Synthetic oligonucleotide"
ugagagaaguccaccacgagucu

SEQ ID NO: 573 - RNA, 23 nt, Artificial Sequence
  source: /note="Description of Artificial Sequence: Synthetic oligonucleotide"
ugagagaaguccaccacgagucu

SEQ ID NO: 574 - RNA, 23 nt, Artificial Sequence
  source: /note="Description of Artificial Sequence: Synthetic oligonucleotide"
ugagagaaguccaccacgagucu

SEQ ID NO: 575 - RNA, 21 nt, Artificial Sequence
  source: /note="Description of Artificial Sequence: Synthetic oligonucleotide"
ugagagaaguccaccacgauu

SEQ ID NO: 576 - RNA, 23 nt, Artificial Sequence
  source: /note="Description of Artificial Sequence: Synthetic oligonucleotide"
ugagagaaguccaccacgagucu

SEQ ID NO: 577 - RNA, 23 nt, Artificial Sequence
  source: /note="Description of Artificial Sequence: Synthetic oligonucleotide"
ugagagaaguccaccacgagucu

SEQ ID NO: 578 - RNA, 23 nt, Artificial Sequence
  source: /note="Description of Artificial Sequence: Synthetic oligonucleotide"
ugagagaaguccaccacgagucu

SEQ ID NO: 579 - RNA, 19 nt, Artificial Sequence
  source: /note="Description of Artificial Sequence: Synthetic oligonucleotide"
ugagagaaguccaccacga

SEQ ID NO: 580 - RNA, 23 nt, Artificial Sequence
  source: /note="Description of Artificial Sequence: Synthetic oligonucleotide"
ugagagaaguccaccacgagucu

SEQ ID NO: 581 - RNA, 21 nt, Artificial Sequence
  source: /note="Description of Artificial Sequence: Synthetic oligonucleotide"
ugagagaaguccaccacgauu

SEQ ID NO: 582 - RNA, 23 nt, Artificial Sequence
  source: /note="Description of Artificial Sequence: Synthetic oligonucleotide"
ugagagaaguccaccacgagucu

SEQ ID NO: 583 - RNA, 23 nt, Artificial Sequence
  source: /note="Description of Artificial Sequence: Synthetic oligonucleotide"
ugagagaaguccaccacgagucu

SEQ ID NO: 584 - RNA, 23 nt, Artificial Sequence
  source: /note="Description of Artificial Sequence: Synthetic oligonucleotide"
ugagagaaguccaccacgagucu

SEQ ID NO: 585 - RNA, 23 nt, Artificial Sequence
  source: /note="Description of Artificial Sequence: Synthetic oligonucleotide"
ugagagaaguccaccacgagucu

SEQ ID NO: 586 - RNA, 23 nt, Artificial Sequence
  source: /note="Description of Artificial Sequence: Synthetic oligonucleotide"
ugagagaaguccaccacgagucu

SEQ ID NO: 587 - RNA, 23 nt, Artificial Sequence
  source: /note="Description of Artificial Sequence: Synthetic oligonucleotide"
ugagagaaguccaccacgagucu

SEQ ID NO: 588 - RNA, 23 nt, Artificial Sequence
  source: /note="Description of Artificial Sequence: Synthetic oligonucleotide"
ugagagaaguccaccacgagucu

SEQ ID NO: 589 - RNA, 23 nt, Artificial Sequence
  source: /note="Description of Artificial Sequence: Synthetic oligonucleotide"
ugagagaaguccaccacgagucu

SEQ ID NO: 590 - RNA, 23 nt, Artificial Sequence
  source: /note="Description of Artificial Sequence: Synthetic oligonucleotide"
ugagagaaguccaccacgagucu

SEQ ID NO: 591 - RNA, 23 nt, Artificial Sequence
  source: /note="Description of Artificial Sequence: Synthetic oligonucleotide"
ugagagaaguccaccacgagucu

SEQ ID NO: 592 - RNA, 23 nt, Artificial Sequence
  source: /note="Description of Artificial Sequence: Synthetic oligonucleotide"
ugagagaaguccaccacgagucu

SEQ ID NO: 593 - RNA, 23 nt, Artificial Sequence
  source: /note="Description of Artificial Sequence: Synthetic oligonucleotide"
ugagagaaguccaccacgagucu

SEQ ID NO: 594 - RNA, 23 nt, Artificial Sequence
  source: /note="Description of Artificial Sequence: Synthetic oligonucleotide"
ugagagaaguccaccacgagucu

SEQ ID NO: 595 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 596 - RNA, 23 nt, Artificial Sequence
  source: /note="Description of Artificial Sequence: Synthetic oligonucleotide"
ugagagaaguccaccacgagucu

SEQ ID NO: 597 - RNA, 23 nt, Artificial Sequence
  source: /note="Description of Artificial Sequence: Synthetic oligonucleotide"
ugagagaaguccaccacgagucu

SEQ ID NO: 598 - RNA, 23 nt, Artificial Sequence
  source: /note="Description of Artificial Sequence: Synthetic oligonucleotide"
ugagagaaguccaccacgagucu

SEQ ID NO: 599 - RNA, 23 nt, Artificial Sequence
  source: /note="Description of Artificial Sequence: Synthetic oligonucleotide"
ugagagaaguccaccacgagucu

SEQ ID NO: 600 - RNA, 23 nt, Artificial Sequence
  source: /note="Description of Artificial Sequence: Synthetic oligonucleotide"
ugagagaaguccaccacgagucu

SEQ ID NO: 601 - RNA, 23 nt, Artificial Sequence
  source: /note="Description of Artificial Sequence: Synthetic oligonucleotide"
ugagagaaguccaccacgagucu

SEQ ID NO: 602 - RNA, 23 nt, Artificial Sequence
  source: /note="Description of Artificial Sequence: Synthetic oligonucleotide"
ugagagaaguccaccacgagucu

SEQ ID NO: 603 - RNA, 23 nt, Artificial Sequence
  source: /note="Description of Artificial Sequence: Synthetic oligonucleotide"
ugagagaaguccaccacgagucu

SEQ ID NO: 604 - RNA, 23 nt, Artificial Sequence
  source: /note="Description of Artificial Sequence: Synthetic oligonucleotide"
ugagagaaguccaccacgagucu

SEQ ID NO: 605 - RNA, 23 nt, Artificial Sequence
  source: /note="Description of Artificial Sequence: Synthetic oligonucleotide"
aaauugagagaaguccaccacga

SEQ ID NO: 606 - RNA, 23 nt, Artificial Sequence
  source: /note="Description of Artificial Sequence: Synthetic oligonucleotide"
aaauugagagaaguccaccacga

SEQ ID NO: 607 - RNA, 23 nt, Artificial Sequence
  source: /note="Description of Artificial Sequence: Synthetic oligonucleotide"
aaauugagagaaguccaccacga

SEQ ID NO: 608 - RNA, 19 nt, Artificial Sequence
  source: /note="Description of Artificial Sequence: Synthetic oligonucleotide"
aaauugagagaaguccacc

SEQ ID NO: 609 - RNA, 23 nt, Artificial Sequence
  source: /note="Description of Artificial Sequence: Synthetic oligonucleotide"
aaauugagagaaguccaccacga

SEQ ID NO: 610 - RNA, 21 nt, Artificial Sequence
  source: /note="Description of Artificial Sequence: Synthetic oligonucleotide"
aaauugagagaaguccaccuu

SEQ ID NO: 611 - RNA, 23 nt, Artificial Sequence
  source: /note="Description of Artificial Sequence: Synthetic oligonucleotide"
aaauugagagaaguccaccacga

SEQ ID NO: 612 - RNA, 23 nt, Artificial Sequence
  source: /note="Description of Artificial Sequence: Synthetic oligonucleotide"
aaauugagagaaguccaccacga

SEQ ID NO: 613 - RNA, 23 nt, Artificial Sequence
  source: /note="Description of Artificial Sequence: Synthetic oligonucleotide"
aaauugagagaaguccaccacga

SEQ ID NO: 614 - RNA, 21 nt, Artificial Sequence
  source: /note="Description of Artificial Sequence: Synthetic oligonucleotide"
aaauugagagaaguccaccac

SEQ ID NO: 615 - RNA, 23 nt, Artificial Sequence
  source: /note="Description of Artificial Sequence: Synthetic oligonucleotide"
aaauugagagaaguccaccacga

SEQ ID NO: 616 - RNA, 21 nt, Artificial Sequence
  source: /note="Description of Artificial Sequence: Synthetic oligonucleotide"
aaauugagagaaguccaccuu

SEQ ID NO: 617 - RNA, 23 nt, Artificial Sequence
  source: /note="Description of Artificial Sequence: Synthetic oligonucleotide"
aaauugagagaaguccaccacga

SEQ ID NO: 618 - RNA, 23 nt, Artificial Sequence
  source: /note="Description of Artificial Sequence: Synthetic oligonucleotide"
aaauugagagaaguccaccacga

SEQ ID NO: 619 - RNA, 19 nt, Artificial Sequence
  source: /note="Description of Artificial Sequence: Synthetic oligonucleotide"
aaauugagagaaguccacc

SEQ ID NO: 620 - RNA, 23 nt, Artificial Sequence
  source: /note="Description of Artificial Sequence: Synthetic oligonucleotide"
aaauugagagaaguccaccacga

SEQ ID NO: 621 - RNA, 21 nt, Artificial Sequence
  source: /note="Description of Artificial Sequence: Synthetic oligonucleotide"
aaauugagagaaguccaccuu

SEQ ID NO: 622 - RNA, 23 nt, Artificial Sequence
  source: /note="Description of Artificial Sequence: Synthetic oligonucleotide"
aaauugagagaaguccaccacga

SEQ ID NO: 623 - RNA, 23 nt, Artificial Sequence
  source: /note="Description of Artificial Sequence: Synthetic oligonucleotide"
aaauugagagaaguccaccacga

SEQ ID NO: 624 - RNA, 23 nt, Artificial Sequence
  source: /note="Description of Artificial Sequence: Synthetic oligonucleotide"
aaauugagagaaguccaccacga

SEQ ID NO: 625 - RNA, 23 nt, Artificial Sequence
  source: /note="Description of Artificial Sequence: Synthetic oligonucleotide"
aaauugagagaaguccaccacga

SEQ ID NO: 626 - RNA, 23 nt, Artificial Sequence
  source: /note="Description of Artificial Sequence: Synthetic oligonucleotide"
aaauugagagaaguccaccacga

SEQ ID NO: 627 - RNA, 23 nt, Artificial Sequence
  source: /note="Description of Artificial Sequence: Synthetic oligonucleotide"
aaauugagagaaguccaccacga

SEQ ID NO: 628 - RNA, 23 nt, Artificial Sequence
  source: /note="Description of Artificial Sequence: Synthetic oligonucleotide"
aaauugagagaaguccaccacga

SEQ ID NO: 629 - RNA, 23 nt, Artificial Sequence
  source: /note="Description of Artificial Sequence: Synthetic oligonucleotide"
aaauugagagaaguccaccacga

SEQ ID NO: 630 - RNA, 23 nt, Artificial Sequence
  source: /note="Description of Artificial Sequence: Synthetic oligonucleotide"
aaauugagagaaguccaccacga

SEQ ID NO: 631 - RNA, 23 nt, Artificial Sequence
  source: /note="Description of Artificial Sequence: Synthetic oligonucleotide"
aaauugagagaaguccaccacga

SEQ ID NO: 632 - RNA, 23 nt, Artificial Sequence
  source: /note="Description of Artificial Sequence: Synthetic oligonucleotide"
aaauugagagaaguccaccacga

SEQ ID NO: 633 - RNA, 23 nt, Artificial Sequence
  source: /note="Description of Artificial Sequence: Synthetic oligonucleotide"
aaauugagagaaguccaccacga

SEQ ID NO: 634 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauugagagaagtccaccacga

SEQ ID NO: 635 - RNA, 23 nt, Artificial Sequence
  source: /note="Description of Artificial Sequence: Synthetic oligonucleotide"
aaauugagagaaguccaccacga

SEQ ID NO: 636 - RNA, 23 nt, Artificial Sequence
  source: /note="Description of Artificial Sequence: Synthetic oligonucleotide"
aaauugagagaaguccaccacga

SEQ ID NO: 637 - RNA, 23 nt, Artificial Sequence
  source: /note="Description of Artificial Sequence: Synthetic oligonucleotide"
aaauugagagaaguccaccacga

SEQ ID NO: 638 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauugagagaagtccaccacga

SEQ ID NO: 639 - RNA, 23 nt, Artificial Sequence
  source: /note="Description of Artificial Sequence: Synthetic oligonucleotide"
aaauugagagaaguccaccacga

SEQ ID NO: 640 - RNA, 23 nt, Artificial Sequence
  source: /note="Description of Artificial Sequence: Synthetic oligonucleotide"
aaauugagagaaguccaccacga

SEQ ID NO: 641 - RNA, 23 nt, Artificial Sequence
  source: /note="Description of Artificial Sequence: Synthetic oligonucleotide"
aaauugagagaaguccaccacga

SEQ ID NO: 642 - RNA, 23 nt, Artificial Sequence
  source: /note="Description of Artificial Sequence: Synthetic oligonucleotide"
aaauugagagaaguccaccacga

SEQ ID NO: 643 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauugagagaagtccaccacga

SEQ ID NO: 644 - RNA, 23 nt, Artificial Sequence
  source: /note="Description of Artificial Sequence: Synthetic oligonucleotide"
aaauugagagaaguccaccacga

SEQ ID NO: 645 - RNA, 23 nt, Artificial Sequence
  source: /note="Description of Artificial Sequence: Synthetic oligonucleotide"
aaauugagagaaguccaccacga

SEQ ID NO: 646 - RNA, 23 nt, Artificial Sequence
  source: /note="Description of Artificial Sequence: Synthetic oligonucleotide"
aaauugagagaaguccaccacga

SEQ ID NO: 647 - RNA, 23 nt, Artificial Sequence
  source: /note="Description of Artificial Sequence: Synthetic oligonucleotide"
aaauugagagaaguccaccacga

SEQ ID NO: 648 - RNA, 21 nt, Artificial Sequence
  source: /note="Description of Artificial Sequence: Synthetic oligonucleotide"
aaauugagagaaguccaccac

SEQ ID NO: 649 - RNA, 23 nt, Artificial Sequence
  source: /note="Description of Artificial Sequence: Synthetic oligonucleotide"
aaauugagagaaguccaccacga

SEQ ID NO: 650 - RNA, 23 nt, Artificial Sequence
  source: /note="Description of Artificial Sequence: Synthetic oligonucleotide"
cagaggugaagcgaagugcacac

SEQ ID NO: 651 - RNA, 23 nt, Artificial Sequence
  source: /note="Description of Artificial Sequence: Synthetic oligonucleotide"
auugugaggauuuuugucaacaa

SEQ ID NO: 652 - RNA, 23 nt, Artificial Sequence
  source: /note="Description of Artificial Sequence: Synthetic oligonucleotide"
uugugaggauuuuugucaacaag

SEQ ID NO: 653 - RNA, 23 nt, Artificial Sequence
  source: /note="Description of Artificial Sequence: Synthetic oligonucleotide"
uaaaauugagagaaguccaccac

SEQ ID NO: 654 - RNA, 23 nt, Artificial Sequence
  source: /note="Description of Artificial Sequence: Synthetic oligonucleotide"
ucgaauccacacuccaaaagaca

SEQ ID NO: 655 - RNA, 23 nt, Artificial Sequence
  source: /note="Description of Artificial Sequence: Synthetic oligonucleotide"
ucgaauccacacuccaaaagaca

SEQ ID NO: 656 - RNA, 23 nt, Artificial Sequence
  source: /note="Description of Artificial Sequence: Synthetic oligonucleotide"
uagcuuggaggcuugaacaagac

SEQ ID NO: 657 - RNA, 23 nt, Artificial Sequence
  source: /note="Description of Artificial Sequence: Synthetic oligonucleotide"
uccgcaguauggaucggcagagg

SEQ ID NO: 658 - RNA, 23 nt, Artificial Sequence
  source: /note="Description of Artificial Sequence: Synthetic oligonucleotide"
uauaaaacgccgcagacacaucc

SEQ ID NO: 659 - RNA, 23 nt, Artificial Sequence
  source: /note="Description of Artificial Sequence: Synthetic oligonucleotide"
uaugagaaggcacagacggggag

SEQ ID NO: 660 - RNA, 23 nt, Artificial Sequence
  source: /note="Description of Artificial Sequence: Synthetic oligonucleotide"
augaacaagagaugauuagcgag

SEQ ID NO: 661 - RNA, 23 nt, Artificial Sequence
  source: /note="Description of Artificial Sequence: Synthetic oligonucleotide"
gaaguccaccacgagucuagacu

SEQ ID NO: 662 - RNA, 23 nt, Artificial Sequence
  source: /note="Description of Artificial Sequence: Synthetic oligonucleotide"
uuccgcaguauggaucggcagag

SEQ ID NO: 663 - RNA, 23 nt, Artificial Sequence
  source: /note="Description of Artificial Sequence: Synthetic oligonucleotide"
uauuuuugucaacaagaaaaacc

SEQ ID NO: 664 - RNA, 23 nt, Artificial Sequence
  source: /note="Description of Artificial Sequence: Synthetic oligonucleotide"
uagaagaaccaacaagaagauga

SEQ ID NO: 665 - RNA, 23 nt, Artificial Sequence
  source: /note="Description of Artificial Sequence: Synthetic oligonucleotide"
auuuuugucaacaagaaaaaccc

SEQ ID NO: 666 - RNA, 23 nt, Artificial Sequence
  source: /note="Description of Artificial Sequence: Synthetic oligonucleotide"
uaacaagagaugauuaggcagag

SEQ ID NO: 667 - RNA, 23 nt, Artificial Sequence
  source: /note="Description of Artificial Sequence: Synthetic oligonucleotide"
uacucugugguauugugaggauu

SEQ ID NO: 668 - RNA, 23 nt, Artificial Sequence
  source: /note="Description of Artificial Sequence: Synthetic oligonucleotide"
uugaggauuuuugucaacaagaa

SEQ ID NO: 669 - RNA, 23 nt, Artificial Sequence
  source: /note="Description of Artificial Sequence: Synthetic oligonucleotide"
aggcagaggugaaaaaguugcau

SEQ ID NO: 670 - RNA, 23 nt, Artificial Sequence
  source: /note="Description of Artificial Sequence: Synthetic oligonucleotide"
uaugcuguagcucuuguucccaa

SEQ ID NO: 671 - RNA, 23 nt, Artificial Sequence
  source: /note="Description of Artificial Sequence: Synthetic oligonucleotide"
aauugagagaaguccaccagcag

SEQ ID NO: 672 - RNA, 23 nt, Artificial Sequence
  source: /note="Description of Artificial Sequence: Synthetic oligonucleotide"
uaagaugaggcauagcagcagga

SEQ ID NO: 673 - RNA, 23 nt, Artificial Sequence
  source: /note="Description of Artificial Sequence: Synthetic oligonucleotide"
aacgccgcagacacauccaacga

SEQ ID NO: 674 - RNA, 23 nt, Artificial Sequence
  source: /note="Description of Artificial Sequence: Synthetic oligonucleotide"
uaggcauagcagcaggaugaaga

SEQ ID NO: 675 - RNA, 23 nt, Artificial Sequence
  source: /note="Description of Artificial Sequence: Synthetic oligonucleotide"
uaggauuuuugucaacaagaaaa

SEQ ID NO: 676 - RNA, 23 nt, Artificial Sequence
  source: /note="Description of Artificial Sequence: Synthetic oligonucleotide"
uaauaccacaucauccauauaac

SEQ ID NO: 677 - RNA, 23 nt, Artificial Sequence
  source: /note="Description of Artificial Sequence: Synthetic oligonucleotide"
gaggcauagcagcaggaugaaga

SEQ ID NO: 678 - RNA, 23 nt, Artificial Sequence
  source: /note="Description of Artificial Sequence: Synthetic oligonucleotide"
uagaggugaagcgaagugcacac

SEQ ID NO: 679 - RNA, 23 nt, Artificial Sequence
  source: /note="Description of Artificial Sequence: Synthetic oligonucleotide"
uauugugaggauuuuugucaaca

SEQ ID NO: 680 - RNA, 23 nt, Artificial Sequence
  source: /note="Description of Artificial Sequence: Synthetic oligonucleotide"
uaaggcacagcuuggaggcuuga

SEQ ID NO: 681 - RNA, 23 nt, Artificial Sequence
  source: /note="Description of Artificial Sequence: Synthetic oligonucleotide"
uauagcagcaggaugaagaggaa

SEQ ID NO: 682 - RNA, 23 nt, Artificial Sequence
  source: /note="Description of Artificial Sequence: Synthetic oligonucleotide"
aagaugaggcauagcagcaggau

SEQ ID NO: 683 - RNA, 23 nt, Artificial Sequence
  source: /note="Description of Artificial Sequence: Synthetic oligonucleotide"
agaagaaccaacaagaagaugag

SEQ ID NO: 684 - RNA, 23 nt, Artificial Sequence
  source: /note="Description of Artificial Sequence: Synthetic oligonucleotide"
uagaugagaaggcacagacgggg

SEQ ID NO: 685 - RNA, 23 nt, Artificial Sequence
  source: /note="Description of Artificial Sequence: Synthetic oligonucleotide"
agaaccaacaagaagaugaggca

SEQ ID NO: 686 - RNA, 23 nt, Artificial Sequence
  source: /note="Description of Artificial Sequence: Synthetic oligonucleotide"
uaagauaggggcauuuggugguc

SEQ ID NO: 687 - RNA, 23 nt, Artificial Sequence
  source: /note="Description of Artificial Sequence: Synthetic oligonucleotide"
aguauggaucggcagaggagcca

SEQ ID NO: 688 - RNA, 23 nt, Artificial Sequence
  source: /note="Description of Artificial Sequence: Synthetic oligonucleotide"
auugugaggauuuuugucaacaa

SEQ ID NO: 689 - RNA, 23 nt, Artificial Sequence
  source: /note="Description of Artificial Sequence: Synthetic oligonucleotide"
uugugaggauuuuugucaacaag

SEQ ID NO: 690 - RNA, 23 nt, Artificial Sequence
  source: /note="Description of Artificial Sequence: Synthetic oligonucleotide"
uaaaauugagagaaguccaccac

SEQ ID NO: 691 - RNA, 23 nt, Artificial Sequence
  source: /note="Description of Artificial Sequence: Synthetic oligonucleotide"
ucgaauccacacuccaaaagaca

SEQ ID NO: 692 - RNA, 23 nt, Artificial Sequence
  source: /note="Description of Artificial Sequence: Synthetic oligonucleotide"
ucgaauccacacuccaaaagaca

SEQ ID NO: 693 - RNA, 23 nt, Artificial Sequence
  source: /note="Description of Artificial Sequence: Synthetic oligonucleotide"
uagcuuggaggcuugaacaagac

SEQ ID NO: 694 - RNA, 23 nt, Artificial Sequence
  source: /note="Description of Artificial Sequence: Synthetic oligonucleotide"
uccgcaguauggaucggcagagg

SEQ ID NO: 695 - RNA, 23 nt, Artificial Sequence
  source: /note="Description of Artificial Sequence: Synthetic oligonucleotide"
uaccacaucauccauauaacuga

SEQ ID NO: 696 - RNA, 23 nt, Artificial Sequence
  source: /note="Description of Artificial Sequence: Synthetic oligonucleotide"
uauaaaacgccgcagacacaucc

SEQ ID NO: 697 - RNA, 23 nt, Artificial Sequence
  source: /note="Description of Artificial Sequence: Synthetic oligonucleotide"
uaugagaaggcacagacggggag

SEQ ID NO: 698 - RNA, 23 nt, Artificial Sequence
  source: /note="Description of Artificial Sequence: Synthetic oligonucleotide"
augaacaagagaugauuagcgag

SEQ ID NO: 699 - RNA, 23 nt, Artificial Sequence
  source: /note="Description of Artificial Sequence: Synthetic oligonucleotide"
gaaguccaccacgagucuagacu

SEQ ID NO: 700 - RNA, 23 nt, Artificial Sequence
  source: /note="Description of Artificial Sequence: Synthetic oligonucleotide"
uuccgcaguauggaucggcagag

SEQ ID NO: 701 - RNA, 23 nt, Artificial Sequence
  source: /note="Description of Artificial Sequence: Synthetic oligonucleotide"
uagaagaaccaacaagaagauga

SEQ ID NO: 702 - RNA, 23 nt, Artificial Sequence
  source: /note="Description of Artificial Sequence: Synthetic oligonucleotide"
uccccuagaaaauugagagaagu

SEQ ID NO: 703 - RNA, 23 nt, Artificial Sequence
  source: /note="Description of Artificial Sequence: Synthetic oligonucleotide"
ugagagaaguccaccacgagucu

SEQ ID NO: 704 - RNA, 23 nt, Artificial Sequence
  source: /note="Description of Artificial Sequence: Synthetic oligonucleotide"
cagaggugaagcgaagugcacac

SEQ ID NO: 705 - RNA, 23 nt, Artificial Sequence
  source: /note="Description of Artificial Sequence: Synthetic oligonucleotide"
auuuuugucaacaagaaaaaccc

SEQ ID NO: 706 - RNA, 23 nt, Artificial Sequence
  source: /note="Description of Artificial Sequence: Synthetic oligonucleotide"
uaacaagagaugauuaggcagag

SEQ ID NO: 707 - RNA, 23 nt, Artificial Sequence
  source: /note="Description of Artificial Sequence: Synthetic oligonucleotide"
uacucugugguauugugaggauu

SEQ ID NO: 708 - RNA, 23 nt, Artificial Sequence
  source: /note="Description of Artificial Sequence: Synthetic oligonucleotide"
uugaggauuuuugucaacaagaa

SEQ ID NO: 709 - RNA, 23 nt, Artificial Sequence
  source: /note="Description of Artificial Sequence: Synthetic oligonucleotide"
aaauugagagaaguccaccacga

SEQ ID NO: 710 - RNA, 23 nt, Artificial Sequence
  source: /note="Description of Artificial Sequence: Synthetic oligonucleotide"
aggcagaggugaaaaaguugcau

SEQ ID NO: 711 - RNA, 23 nt, Artificial Sequence
  source: /note="Description of Artificial Sequence: Synthetic oligonucleotide"
uaugcuguagcucuuguucccaa

SEQ ID NO: 712 - RNA, 23 nt, Artificial Sequence
  source: /note="Description of Artificial Sequence: Synthetic oligonucleotide"
uaagaaccaacaagaagaugagg

SEQ ID NO: 713 - RNA, 23 nt, Artificial Sequence
  source: /note="Description of Artificial Sequence: Synthetic oligonucleotide"
uaagaugaggcauagcagcagga

SEQ ID NO: 714 - RNA, 23 nt, Artificial Sequence
  source: /note="Description of Artificial Sequence: Synthetic oligonucleotide"
aacgccgcagacacauccaacga

SEQ ID NO: 715 - RNA, 23 nt, Artificial Sequence
  source: /note="Description of Artificial Sequence: Synthetic oligonucleotide"
uaggcauagcagcaggaugaaga

SEQ ID NO: 716 - RNA, 23 nt, Artificial Sequence
  source: /note="Description of Artificial Sequence: Synthetic oligonucleotide"
uaggauuuuugucaacaagaaaa

SEQ ID NO: 717 - RNA, 23 nt, Artificial Sequence
  source: /note="Description of Artificial Sequence: Synthetic oligonucleotide"
uaaaacgccgcagacacauccag

SEQ ID NO: 718 - RNA, 23 nt, Artificial Sequence
  source: /note="Description of Artificial Sequence: Synthetic oligonucleotide"
uaauaccacaucauccauauaac

SEQ ID NO: 719 - RNA, 23 nt, Artificial Sequence
  source: /note="Description of Artificial Sequence: Synthetic oligonucleotide"
gaggcauagcagcaggaugaaga

SEQ ID NO: 720 - RNA, 23 nt, Artificial Sequence
  source: /note="Description of Artificial Sequence: Synthetic oligonucleotide"
uagaggugaagcgaagugcacac

SEQ ID NO: 721 - RNA, 23 nt, Artificial Sequence
  source: /note="Description of Artificial Sequence: Synthetic oligonucleotide"
uauugugaggauuuuugucaaca

SEQ ID NO: 722 - RNA, 23 nt, Artificial Sequence
  source: /note="Description of Artificial Sequence: Synthetic oligonucleotide"
uuugcgucagcaaacacuuggca

SEQ ID NO: 723 - RNA, 23 nt, Artificial Sequence
  source: /note="Description of Artificial Sequence: Synthetic oligonucleotide"
uuugcgucagcaaacacuuggca

SEQ ID NO: 724 - RNA, 23 nt, Artificial Sequence
  source: /note="Description of Artificial Sequence: Synthetic oligonucleotide"
uaaggcacagcuuggaggcuuga

SEQ ID NO: 725 - RNA, 23 nt, Artificial Sequence
  source: /note="Description of Artificial Sequence: Synthetic oligonucleotide"
uauagcagcaggaugaagaggaa

SEQ ID NO: 726 - RNA, 23 nt, Artificial Sequence
  source: /note="Description of Artificial Sequence: Synthetic oligonucleotide"
aagaugaggcauagcagcaggau

SEQ ID NO: 727 - RNA, 23 nt, Artificial Sequence
  source: /note="Description of Artificial Sequence: Synthetic oligonucleotide"
agaagaaccaacaagaagaugag

SEQ ID NO: 728 - RNA, 23 nt, Artificial Sequence
  source: /note="Description of Artificial Sequence: Synthetic oligonucleotide"
uagaugagaaggcacagacgggg

SEQ ID NO: 729 - RNA, 23 nt, Artificial Sequence
  source: /note="Description of Artificial Sequence: Synthetic oligonucleotide"
agaaccaacaagaagaugaggca

SEQ ID NO: 730 - RNA, 23 nt, Artificial Sequence
  source: /note="Description of Artificial Sequence: Synthetic oligonucleotide"
uaagauaggggcauuuggugguc

SEQ ID NO: 731 - RNA, 23 nt, Artificial Sequence
  source: /note="Description of Artificial Sequence: Synthetic oligonucleotide"
aguauggaucggcagaggagcca

SEQ ID NO: 732 - RNA, 23 nt, Artificial Sequence
  source: /note="Description of Artificial Sequence: Synthetic oligonucleotide"
ugagagaaguccaccacgagucu

SEQ ID NO: 733 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 734 - RNA, 23 nt, Artificial Sequence
  source: /note="Description of Artificial Sequence: Synthetic oligonucleotide"
ugagagaaguccaccacgagucu

SEQ ID NO: 735 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 736 - RNA, 23 nt, Artificial Sequence
  source: /note="Description of Artificial Sequence: Synthetic oligonucleotide"
ugagagaaguccaccacgagucu

SEQ ID NO: 737 - RNA, 23 nt, Artificial Sequence
  source: /note="Description of Artificial Sequence: Synthetic oligonucleotide"
ugagagaaguccaccacgagucu

SEQ ID NO: 738 - RNA, 23 nt, Artificial Sequence
  source: /note="Description of Artificial Sequence: Synthetic oligonucleotide"
ugagagaaguccaccacgagucu

SEQ ID NO: 739 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 740 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 741 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 742 - RNA, 23 nt, Artificial Sequence
  source: /note="Description of Artificial Sequence: Synthetic oligonucleotide"
ugagagaaguccaccacgagucu

SEQ ID NO: 743 - RNA, 23 nt, Artificial Sequence
  source: /note="Description of Artificial Sequence: Synthetic oligonucleotide"
ugagagaaguccaccacgagucu

SEQ ID NO: 744 - RNA, 23 nt, Artificial Sequence
  source: /note="Description of Artificial Sequence: Synthetic oligonucleotide"
ugagagaaguccaccacgagucu

SEQ ID NO: 745 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 746 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 747 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 748 - RNA, 23 nt, Artificial Sequence
  source: /note="Description of Artificial Sequence: Synthetic oligonucleotide"
ugagagaaguccaccacgagucu

SEQ ID NO: 749 - RNA, 23 nt, Artificial Sequence
  source: /note="Description of Artificial Sequence: Synthetic oligonucleotide"
ugagagaaguccaccacgagucu

SEQ ID NO: 750 - RNA, 23 nt, Artificial Sequence
  source: /note="Description of Artificial Sequence: Synthetic oligonucleotide"
ugagagaaguccaccacgagucu

SEQ ID NO: 751 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 752 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 753 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 754 - RNA, 23 nt, Artificial Sequence
  source: /note="Description of Artificial Sequence: Synthetic oligonucleotide"
ugagagaaguccaccacgagucu

SEQ ID NO: 755 - RNA, 23 nt, Artificial Sequence
  source: /note="Description of Artificial Sequence: Synthetic oligonucleotide"
ugagagaaguccaccacgagucu

SEQ ID NO: 756 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 757 - RNA, 23 nt, Artificial Sequence
  source: /note="Description of Artificial Sequence: Synthetic oligonucleotide"
ugagagaaguccaccacgagucu

SEQ ID NO: 758 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 759 - RNA, 23 nt, Artificial Sequence
  source: /note="Description of Artificial Sequence: Synthetic oligonucleotide"
ugagagaaguccaccacgagucu

SEQ ID NO: 760 - RNA, 23 nt, Artificial Sequence
  source: /note="Description of Artificial Sequence: Synthetic oligonucleotide"
ugagagaaguccaccacgagucu

SEQ ID NO: 761 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 762 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 763 - RNA, 23 nt, Artificial Sequence
  source: /note="Description of Artificial Sequence: Synthetic oligonucleotide"
ugagagaaguccaccacgagucu

SEQ ID NO: 764 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 765 - RNA, 23 nt, Artificial Sequence
  source: /note="Description of Artificial Sequence: Synthetic oligonucleotide"
ugagagaaguccaccacgagucu

SEQ ID NO: 766 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 767 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 768 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 769 - RNA, 23 nt, Artificial Sequence
  source: /note="Description of Artificial Sequence: Synthetic oligonucleotide"
ugagagaaguccaccacgagucu

SEQ ID NO: 770 - RNA, 23 nt, Artificial Sequence
  source: /note="Description of Artificial Sequence: Synthetic oligonucleotide"
ugagagaaguccaccacgagucu

SEQ ID NO: 771 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 772 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 773 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 774 - RNA, 23 nt, Artificial Sequence
  source: /note="Description of Artificial Sequence: Synthetic oligonucleotide"
ugagagaaguccaccacgagucu

SEQ ID NO: 775 - RNA, 23 nt, Artificial Sequence
  source: /note="Description of Artificial Sequence: Synthetic oligonucleotide"
uaccacaucauccauauaacuga

SEQ ID NO: 776 - RNA, 23 nt, Artificial Sequence
  source: /note="Description of Artificial Sequence: Synthetic oligonucleotide"
uaaaacgccgcagacacauccag

SEQ ID NO: 777 - RNA, 23 nt, Artificial Sequence
  source: /note="Description of Artificial Sequence: Synthetic oligonucleotide"
ugagagaaguccaccacgagucu

SEQ ID NO: 778 - RNA, 23 nt, Artificial Sequence
  source: /note="Description of Artificial Sequence: Synthetic oligonucleotide"
ugagagaaguccaccacgagucu

SEQ ID NO: 779 - RNA, 23 nt, Artificial Sequence
  source: /note="Description of Artificial Sequence: Synthetic oligonucleotide"
ugagagaaguccaccacgagucu

SEQ ID NO: 780 - RNA, 23 nt, Artificial Sequence
  source: /note="Description of Artificial Sequence: Synthetic oligonucleotide"
ugagagaaguccaccacgagucu

SEQ ID NO: 781 - RNA, 21 nt, Artificial Sequence
  source: /note="Description of Artificial Sequence: Synthetic oligonucleotide"
ugagagaaguccaccacgagu

SEQ ID NO: 782 - RNA, 23 nt, Artificial Sequence
  source: /note="Description of Artificial Sequence: Synthetic oligonucleotide"
ugagagaaguccaccacgagucu

SEQ ID NO: 783 - RNA, 23 nt, Artificial Sequence
  source: /note="Description of Artificial Sequence: Synthetic oligonucleotide"
ugagagaaguccaccacgagucu

SEQ ID NO: 784 - RNA, 23 nt, Artificial Sequence
  source: /note="Description of Artificial Sequence: Synthetic oligonucleotide"
ugagagaaguccaccacgagucu

SEQ ID NO: 785 - RNA, 23 nt, Artificial Sequence
  source: /note="Description of Artificial Sequence: Synthetic oligonucleotide"
ugagagaaguccaccacgagucu

SEQ ID NO: 786 - RNA, 19 nt, Artificial Sequence
  source: /note="Description of Artificial Sequence: Synthetic oligonucleotide"
ugagagaaguccaccacga

SEQ ID NO: 787 - RNA, 23 nt, Artificial Sequence
  source: /note="Description of Artificial Sequence: Synthetic oligonucleotide"
ugagagaaguccaccacgagucu

SEQ ID NO: 788 - RNA, 21 nt, Artificial Sequence
  source: /note="Description of Artificial Sequence: Synthetic oligonucleotide"
ugagagaaguccaccacgauu

SEQ ID NO: 789 - RNA, 23 nt, Artificial Sequence
  source: /note="Description of Artificial Sequence: Synthetic oligonucleotide"
ugagagaaguccaccacgagucu

SEQ ID NO: 790 - RNA, 23 nt, Artificial Sequence
  source: /note="Description of Artificial Sequence: Synthetic oligonucleotide"
ugagagaaguccaccacgagucu

SEQ ID NO: 791 - RNA, 23 nt, Artificial Sequence
  source: /note="Description of Artificial Sequence: Synthetic oligonucleotide"
ugagagaaguccaccacgagucu

SEQ ID NO: 792 - RNA, 23 nt, Artificial Sequence
  source: /note="Description of Artificial Sequence: Synthetic oligonucleotide"
ugagagaaguccaccacgagucu

SEQ ID NO: 793 - RNA, 21 nt, Artificial Sequence
  source: /note="Description of Artificial Sequence: Synthetic oligonucleotide"
ugagagaaguccaccacgauu

SEQ ID NO: 794 - RNA, 23 nt, Artificial Sequence
  source: /note="Description of Artificial Sequence: Synthetic oligonucleotide"
ugagagaaguccaccacgagucu

SEQ ID NO: 795 - RNA, 23 nt, Artificial Sequence
  source: /note="Description of Artificial Sequence: Synthetic oligonucleotide"
ugagagaaguccaccacgagucu

SEQ ID NO: 796 - RNA, 23 nt, Artificial Sequence
  source: /note="Description of Artificial Sequence: Synthetic oligonucleotide"
ugagagaaguccaccacgagucu

SEQ ID NO: 797 - RNA, 19 nt, Artificial Sequence
  source: /note="Description of Artificial Sequence: Synthetic oligonucleotide"
ugagagaaguccaccacga

SEQ ID NO: 798 - RNA, 23 nt, Artificial Sequence
  source: /note="Description of Artificial Sequence: Synthetic oligonucleotide"
ugagagaaguccaccacgagucu

SEQ ID NO: 799 - RNA, 21 nt, Artificial Sequence
  source: /note="Description of Artificial Sequence: Synthetic oligonucleotide"
ugagagaaguccaccacgauu

SEQ ID NO: 800 - RNA, 23 nt, Artificial Sequence
  source: /note="Description of Artificial Sequence: Synthetic oligonucleotide"
ugagagaaguccaccacgagucu

SEQ ID NO: 801 - RNA, 23 nt, Artificial Sequence
  source: /note="Description of Artificial Sequence: Synthetic oligonucleotide"
ugagagaaguccaccacgagucu

SEQ ID NO: 802 - RNA, 23 nt, Artificial Sequence
  source: /note="Description of Artificial Sequence: Synthetic oligonucleotide"
ugagagaaguccaccacgagucu

SEQ ID NO: 803 - RNA, 23 nt, Artificial Sequence
  source: /note="Description of Artificial Sequence: Synthetic oligonucleotide"
ugagagaaguccaccacgagucu

SEQ ID NO: 804 - RNA, 23 nt, Artificial Sequence
  source: /note="Description of Artificial Sequence: Synthetic oligonucleotide"
ugagagaaguccaccacgagucu

SEQ ID NO: 805 - RNA, 23 nt, Artificial Sequence
  source: /note="Description of Artificial Sequence: Synthetic oligonucleotide"
ugagagaaguccaccacgagucu

SEQ ID NO: 806 - RNA, 23 nt, Artificial Sequence
  source: /note="Description of Artificial Sequence: Synthetic oligonucleotide"
ugagagaaguccaccacgagucu

SEQ ID NO: 807 - RNA, 23 nt, Artificial Sequence
  source: /note="Description of Artificial Sequence: Synthetic oligonucleotide"
ugagagaaguccaccacgagucu

SEQ ID NO: 808 - RNA, 23 nt, Artificial Sequence
  source: /note="Description of Artificial Sequence: Synthetic oligonucleotide"
ugagagaaguccaccacgagucu

SEQ ID NO: 809 - RNA, 23 nt, Artificial Sequence
  source: /note="Description of Artificial Sequence: Synthetic oligonucleotide"
ugagagaaguccaccacgagucu

SEQ ID NO: 810 - RNA, 23 nt, Artificial Sequence
  source: /note="Description of Artificial Sequence: Synthetic oligonucleotide"
ugagagaaguccaccacgagucu

SEQ ID NO: 811 - RNA, 23 nt, Artificial Sequence
  source: /note="Description of Artificial Sequence: Synthetic oligonucleotide"
ugagagaaguccaccacgagucu

SEQ ID NO: 812 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 813 - RNA, 23 nt, Artificial Sequence
  source: /note="Description of Artificial Sequence: Synthetic oligonucleotide"
ugagagaaguccaccacgagucu

SEQ ID NO: 814 - RNA, 23 nt, Artificial Sequence
  source: /note="Description of Artificial Sequence: Synthetic oligonucleotide"
ugagagaaguccaccacgagucu

SEQ ID NO: 815 - RNA, 23 nt, Artificial Sequence
  source: /note="Description of Artificial Sequence: Synthetic oligonucleotide"
ugagagaaguccaccacgagucu

SEQ ID NO: 816 - RNA, 23 nt, Artificial Sequence
  source: /note="Description of Artificial Sequence: Synthetic oligonucleotide"
ugagagaaguccaccacgagucu

SEQ ID NO: 817 - RNA, 23 nt, Artificial Sequence
  source: /note="Description of Artificial Sequence: Synthetic oligonucleotide"
ugagagaaguccaccacgagucu

SEQ ID NO: 818 - RNA, 23 nt, Artificial Sequence
  source: /note="Description of Artificial Sequence: Synthetic oligonucleotide"
ugagagaaguccaccacgagucu

SEQ ID NO: 819 - RNA, 23 nt, Artificial Sequence
  source: /note="Description of Artificial Sequence: Synthetic oligonucleotide"
ugagagaaguccaccacgagucu

SEQ ID NO: 820 - RNA, 23 nt, Artificial Sequence
  source: /note="Description of Artificial Sequence: Synthetic oligonucleotide"
ugagagaaguccaccacgagucu

SEQ ID NO: 821 - RNA, 23 nt, Artificial Sequence
  source: /note="Description of Artificial Sequence: Synthetic oligonucleotide"
ugagagaaguccaccacgagucu

SEQ ID NO: 822 - RNA, 23 nt, Artificial Sequence
  source: /note="Description of Artificial Sequence: Synthetic oligonucleotide"
aaauugagagaaguccaccacga

SEQ ID NO: 823 - RNA, 23 nt, Artificial Sequence
  source: /note="Description of Artificial Sequence: Synthetic oligonucleotide"
aaauugagagaaguccaccacga

SEQ ID NO: 824 - RNA, 23 nt, Artificial Sequence
  source: /note="Description of Artificial Sequence: Synthetic oligonucleotide"
aaauugagagaaguccaccacga

SEQ ID NO: 825 - RNA, 19 nt, Artificial Sequence
  source: /note="Description of Artificial Sequence: Synthetic oligonucleotide"
aaauugagagaaguccacc

SEQ ID NO: 826 - RNA, 23 nt, Artificial Sequence
  source: /note="Description of Artificial Sequence: Synthetic oligonucleotide"
aaauugagagaaguccaccacga

SEQ ID NO: 827 - RNA, 21 nt, Artificial Sequence
  source: /note="Description of Artificial Sequence: Synthetic oligonucleotide"
aaauugagagaaguccaccuu

SEQ ID NO: 828 - RNA, 23 nt, Artificial Sequence
  source: /note="Description of Artificial Sequence: Synthetic oligonucleotide"
aaauugagagaaguccaccacga

SEQ ID NO: 829 - RNA, 23 nt, Artificial Sequence
  source: /note="Description of Artificial Sequence: Synthetic oligonucleotide"
aaauugagagaaguccaccacga

SEQ ID NO: 830 - RNA, 23 nt, Artificial Sequence
  source: /note="Description of Artificial Sequence: Synthetic oligonucleotide"
aaauugagagaaguccaccacga

SEQ ID NO: 831 - RNA, 21 nt, Artificial Sequence
  source: /note="Description of Artificial Sequence: Synthetic oligonucleotide"
aaauugagagaaguccaccac

SEQ ID NO: 832 - RNA, 23 nt, Artificial Sequence
  source: /note="Description of Artificial Sequence: Synthetic oligonucleotide"
aaauugagagaaguccaccacga

SEQ ID NO: 833 - RNA, 21 nt, Artificial Sequence
  source: /note="Description of Artificial Sequence: Synthetic oligonucleotide"
aaauugagagaaguccaccuu

SEQ ID NO: 834 - RNA, 23 nt, Artificial Sequence
  source: /note="Description of Artificial Sequence: Synthetic oligonucleotide"
aaauugagagaaguccaccacga

SEQ ID NO: 835 - RNA, 23 nt, Artificial Sequence
  source: /note="Description of Artificial Sequence: Synthetic oligonucleotide"
aaauugagagaaguccaccacga

SEQ ID NO: 836 - RNA, 19 nt, Artificial Sequence
  source: /note="Description of Artificial Sequence: Synthetic oligonucleotide"
aaauugagagaaguccacc

SEQ ID NO: 837 - RNA, 23 nt, Artificial Sequence
  source: /note="Description of Artificial Sequence: Synthetic oligonucleotide"
aaauugagagaaguccaccacga

SEQ ID NO: 838 - RNA, 21 nt, Artificial Sequence
  source: /note="Description of Artificial Sequence: Synthetic oligonucleotide"
aaauugagagaaguccaccuu

SEQ ID NO: 839 - RNA, 23 nt, Artificial Sequence
  source: /note="Description of Artificial Sequence: Synthetic oligonucleotide"
aaauugagagaaguccaccacga

SEQ ID NO: 840 - RNA, 23 nt, Artificial Sequence
  source: /note="Description of Artificial Sequence: Synthetic oligonucleotide"
aaauugagagaaguccaccacga

SEQ ID NO: 841 - RNA, 23 nt, Artificial Sequence
  source: /note="Description of Artificial Sequence: Synthetic oligonucleotide"
aaauugagagaaguccaccacga

SEQ ID NO: 842 - RNA, 23 nt, Artificial Sequence
  source: /note="Description of Artificial Sequence: Synthetic oligonucleotide"
aaauugagagaaguccaccacga

SEQ ID NO: 843 - RNA, 23 nt, Artificial Sequence
  source: /note="Description of Artificial Sequence: Synthetic oligonucleotide"
aaauugagagaaguccaccacga

SEQ ID NO: 844 - RNA, 23 nt, Artificial Sequence
  source: /note="Description of Artificial Sequence: Synthetic oligonucleotide"
aaauugagagaaguccaccacga

SEQ ID NO: 845 - RNA, 23 nt, Artificial Sequence
  source: /note="Description of Artificial Sequence: Synthetic oligonucleotide"
aaauugagagaaguccaccacga

SEQ ID NO: 846 - RNA, 23 nt, Artificial Sequence
  source: /note="Description of Artificial Sequence: Synthetic oligonucleotide"
aaauugagagaaguccaccacga

SEQ ID NO: 847 - RNA, 23 nt, Artificial Sequence
  source: /note="Description of Artificial Sequence: Synthetic oligonucleotide"
aaauugagagaaguccaccacga

SEQ ID NO: 848 - RNA, 23 nt, Artificial Sequence
  source: /note="Description of Artificial Sequence: Synthetic oligonucleotide"
aaauugagagaaguccaccacga

SEQ ID NO: 849 - RNA, 23 nt, Artificial Sequence
  source: /note="Description of Artificial Sequence: Synthetic oligonucleotide"
aaauugagagaaguccaccacga

SEQ ID NO: 850 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauugagagaagtccaccacga

SEQ ID NO: 851 - RNA, 23 nt, Artificial Sequence
  source: /note="Description of Artificial Sequence: Synthetic oligonucleotide"
aaauugagagaaguccaccacga

SEQ ID NO: 852 - RNA, 23 nt, Artificial Sequence
  source: /note="Description of Artificial Sequence: Synthetic oligonucleotide"
aaauugagagaaguccaccacga

SEQ ID NO: 853 - RNA, 23 nt, Artificial Sequence
  source: /note="Description of Artificial Sequence: Synthetic oligonucleotide"
aaauugagagaaguccaccacga

SEQ ID NO: 854 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauugagagaagtccaccacga

SEQ ID NO: 855 - RNA, 23 nt, Artificial Sequence
  source: /note="Description of Artificial Sequence: Synthetic oligonucleotide"
aaauugagagaaguccaccacga

SEQ ID NO: 856 - RNA, 23 nt, Artificial Sequence
  source: /note="Description of Artificial Sequence: Synthetic oligonucleotide"
aaauugagagaaguccaccacga

SEQ ID NO: 857 - RNA, 23 nt, Artificial Sequence
  source: /note="Description of Artificial Sequence: Synthetic oligonucleotide"
aaauugagagaaguccaccacga

SEQ ID NO: 858 - RNA, 23 nt, Artificial Sequence
  source: /note="Description of Artificial Sequence: Synthetic oligonucleotide"
aaauugagagaaguccaccacga

SEQ ID NO: 859 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauugagagaagtccaccacga

SEQ ID NO: 860 - RNA, 23 nt, Artificial Sequence
  source: /note="Description of Artificial Sequence: Synthetic oligonucleotide"
aaauugagagaaguccaccacga

SEQ ID NO: 861 - RNA, 23 nt, Artificial Sequence
  source: /note="Description of Artificial Sequence: Synthetic oligonucleotide"
aaauugagagaaguccaccacga

SEQ ID NO: 862 - RNA, 23 nt, Artificial Sequence
  source: /note="Description of Artificial Sequence: Synthetic oligonucleotide"
aaauugagagaaguccaccacga

SEQ ID NO: 863 - RNA, 23 nt, Artificial Sequence
  source: /note="Description of Artificial Sequence: Synthetic oligonucleotide"
aaauugagagaaguccaccacga

SEQ ID NO: 864 - RNA, 21 nt, Artificial Sequence
  source: /note="Description of Artificial Sequence: Synthetic oligonucleotide"
aaauugagagaaguccaccac

SEQ ID NO: 865 - RNA, 23 nt, Artificial Sequence
  source: /note="Description of Artificial Sequence: Synthetic oligonucleotide"
aaauugagagaaguccaccacga

SEQ ID NO: 866 - RNA, 23 nt, Artificial Sequence
  source: /note="Description of Artificial Sequence: Synthetic oligonucleotide"
cagaggugaagcgaagugcacac

SEQ ID NO: 867 - RNA, 23 nt, Artificial Sequence
  source: /note="Description of Artificial Sequence: Synthetic oligonucleotide"
auugugaggauuuuugucaacaa

SEQ ID NO: 868 - RNA, 23 nt, Artificial Sequence
  source: /note="Description of Artificial Sequence: Synthetic oligonucleotide"
uugugaggauuuuugucaacaag

SEQ ID NO: 869 - RNA, 23 nt, Artificial Sequence
  source: /note="Description of Artificial Sequence: Synthetic oligonucleotide"
uaaaauugagagaaguccaccac

SEQ ID NO: 870 - RNA, 23 nt, Artificial Sequence
  source: /note="Description of Artificial Sequence: Synthetic oligonucleotide"
ucgaauccacacuccaaaagaca

SEQ ID NO: 871 - RNA, 23 nt, Artificial Sequence
  source: /note="Description of Artificial Sequence: Synthetic oligonucleotide"
ucgaauccacacuccaaaagaca

SEQ ID NO: 872 - RNA, 23 nt, Artificial Sequence
  source: /note="Description of Artificial Sequence: Synthetic oligonucleotide"
uagcuuggaggcuugaacaagac

SEQ ID NO: 873 - RNA, 23 nt, Artificial Sequence
  source: /note="Description of Artificial Sequence: Synthetic oligonucleotide"
uccgcaguauggaucggcagagg

SEQ ID NO: 874 - RNA, 23 nt, Artificial Sequence
  source: /note="Description of Artificial Sequence: Synthetic oligonucleotide"
uauaaaacgccgcagacacaucc

SEQ ID NO: 875 - RNA, 23 nt, Artificial Sequence
  source: /note="Description of Artificial Sequence: Synthetic oligonucleotide"
uaugagaaggcacagacggggag

SEQ ID NO: 876 - RNA, 23 nt, Artificial Sequence
  source: /note="Description of Artificial Sequence: Synthetic oligonucleotide"
augaacaagagaugauuagcgag

SEQ ID NO: 877 - RNA, 23 nt, Artificial Sequence
  source: /note="Description of Artificial Sequence: Synthetic oligonucleotide"
gaaguccaccacgagucuagacu

SEQ ID NO: 878 - RNA, 23 nt, Artificial Sequence
  source: /note="Description of Artificial Sequence: Synthetic oligonucleotide"
uuccgcaguauggaucggcagag

SEQ ID NO: 879 - RNA, 23 nt, Artificial Sequence
  source: /note="Description of Artificial Sequence: Synthetic oligonucleotide"
uauuuuugucaacaagaaaaacc

SEQ ID NO: 880 - RNA, 23 nt, Artificial Sequence
  source: /note="Description of Artificial Sequence: Synthetic oligonucleotide"
uagaagaaccaacaagaagauga

SEQ ID NO: 881 - RNA, 23 nt, Artificial Sequence
  source: /note="Description of Artificial Sequence: Synthetic oligonucleotide"
auuuuugucaacaagaaaaaccc

SEQ ID NO: 882 - RNA, 23 nt, Artificial Sequence
  source: /note="Description of Artificial Sequence: Synthetic oligonucleotide"
uaacaagagaugauuaggcagag

SEQ ID NO: 883 - RNA, 23 nt, Artificial Sequence
  source: /note="Description of Artificial Sequence: Synthetic oligonucleotide"
uacucugugguauugugaggauu

SEQ ID NO: 884 - RNA, 23 nt, Artificial Sequence
  source: /note="Description of Artificial Sequence: Synthetic oligonucleotide"
uugaggauuuuugucaacaagaa

SEQ ID NO: 885 - RNA, 23 nt, Artificial Sequence
  source: /note="Description of Artificial Sequence: Synthetic oligonucleotide"
aggcagaggugaaaaaguugcau

SEQ ID NO: 886 - RNA, 23 nt, Artificial Sequence
  source: /note="Description of Artificial Sequence: Synthetic oligonucleotide"
uaugcuguagcucuuguucccaa

SEQ ID NO: 887 - RNA, 23 nt, Artificial Sequence
  source: /note="Description of Artificial Sequence: Synthetic oligonucleotide"
aauugagagaaguccaccagcag

SEQ ID NO: 888 - RNA, 23 nt, Artificial Sequence
  source: /note="Description of Artificial Sequence: Synthetic oligonucleotide"
uaagaugaggcauagcagcagga

SEQ ID NO: 889 - RNA, 23 nt, Artificial Sequence
  source: /note="Description of Artificial Sequence: Synthetic oligonucleotide"
aacgccgcagacacauccaacga

SEQ ID NO: 890 - RNA, 23 nt, Artificial Sequence
  source: /note="Description of Artificial Sequence: Synthetic oligonucleotide"
uaggcauagcagcaggaugaaga

SEQ ID NO: 891 - RNA, 23 nt, Artificial Sequence
  source: /note="Description of Artificial Sequence: Synthetic oligonucleotide"
uaggauuuuugucaacaagaaaa

SEQ ID NO: 892 - RNA, 23 nt, Artificial Sequence
  source: /note="Description of Artificial Sequence: Synthetic oligonucleotide"
uaauaccacaucauccauauaac

SEQ ID NO: 893 - RNA, 23 nt, Artificial Sequence
  source: /note="Description of Artificial Sequence: Synthetic oligonucleotide"
gaggcauagcagcaggaugaaga

SEQ ID NO: 894 - RNA, 23 nt, Artificial Sequence
  source: /note="Description of Artificial Sequence: Synthetic oligonucleotide"
uagaggugaagcgaagugcacac

SEQ ID NO: 895 - RNA, 23 nt, Artificial Sequence
  source: /note="Description of Artificial Sequence: Synthetic oligonucleotide"
uauugugaggauuuuugucaaca

SEQ ID NO: 896 - RNA, 23 nt, Artificial Sequence
  source: /note="Description of Artificial Sequence: Synthetic oligonucleotide"
uaaggcacagcuuggaggcuuga

SEQ ID NO: 897 - RNA, 23 nt, Artificial Sequence
  source: /note="Description of Artificial Sequence: Synthetic oligonucleotide"
uauagcagcaggaugaagaggaa

SEQ ID NO: 898 - RNA, 23 nt, Artificial Sequence
  source: /note="Description of Artificial Sequence: Synthetic oligonucleotide"
aagaugaggcauagcagcaggau

SEQ ID NO: 899 - RNA, 23 nt, Artificial Sequence
  source: /note="Description of Artificial Sequence: Synthetic oligonucleotide"
agaagaaccaacaagaagaugag

SEQ ID NO: 900 - RNA, 23 nt, Artificial Sequence
  source: /note="Description of Artificial Sequence: Synthetic oligonucleotide"
uagaugagaaggcacagacgggg

SEQ ID NO: 901 - RNA, 23 nt, Artificial Sequence
  source: /note="Description of Artificial Sequence: Synthetic oligonucleotide"
agaaccaacaagaagaugaggca

SEQ ID NO: 902 - RNA, 23 nt, Artificial Sequence
  source: /note="Description of Artificial Sequence: Synthetic oligonucleotide"
uaagauaggggcauuuggugguc

SEQ ID NO: 903 - RNA, 23 nt, Artificial Sequence
  source: /note="Description of Artificial Sequence: Synthetic oligonucleotide"
aguauggaucggcagaggagcca

SEQ ID NO: 904 - RNA, 23 nt, Artificial Sequence
  source: /note="Description of Artificial Sequence: Synthetic oligonucleotide"
auugugaggauuuuugucaacaa

SEQ ID NO: 905 - RNA, 23 nt, Artificial Sequence
  source: /note="Description of Artificial Sequence: Synthetic oligonucleotide"
uugugaggauuuuugucaacaag

SEQ ID NO: 906 - RNA, 23 nt, Artificial Sequence
  source: /note="Description of Artificial Sequence: Synthetic oligonucleotide"
uaaaauugagagaaguccaccac

SEQ ID NO: 907 - RNA, 23 nt, Artificial Sequence
  source: /note="Description of Artificial Sequence: Synthetic oligonucleotide"
ucgaauccacacuccaaaagaca

SEQ ID NO: 908 - RNA, 23 nt, Artificial Sequence
  source: /note="Description of Artificial Sequence: Synthetic oligonucleotide"
ucgaauccacacuccaaaagaca

SEQ ID NO: 909 - RNA, 23 nt, Artificial Sequence
  source: /note="Description of Artificial Sequence: Synthetic oligonucleotide"
uagcuuggaggcuugaacaagac

SEQ ID NO: 910 - RNA, 23 nt, Artificial Sequence
  source: /note="Description of Artificial Sequence: Synthetic oligonucleotide"
uccgcaguauggaucggcagagg

SEQ ID NO: 911 - RNA, 23 nt, Artificial Sequence
  source: /note="Description of Artificial Sequence: Synthetic oligonucleotide"
uaccacaucauccauauaacuga

SEQ ID NO: 912 - RNA, 23 nt, Artificial Sequence
  source: /note="Description of Artificial Sequence: Synthetic oligonucleotide"
uauaaaacgccgcagacacaucc

SEQ ID NO: 913 - RNA, 23 nt, Artificial Sequence
  source: /note="Description of Artificial Sequence: Synthetic oligonucleotide"
uaugagaaggcacagacggggag

SEQ ID NO: 914 - RNA, 23 nt, Artificial Sequence
  source: /note="Description of Artificial Sequence: Synthetic oligonucleotide"
augaacaagagaugauuagcgag

SEQ ID NO: 915 - RNA, 23 nt, Artificial Sequence
  source: /note="Description of Artificial Sequence: Synthetic oligonucleotide"
gaaguccaccacgagucuagacu

SEQ ID NO: 916 - RNA, 23 nt, Artificial Sequence
  source: /note="Description of Artificial Sequence: Synthetic oligonucleotide"
uuccgcaguauggaucggcagag

SEQ ID NO: 917 - RNA, 23 nt, Artificial Sequence
  source: /note="Description of Artificial Sequence: Synthetic oligonucleotide"
uagaagaaccaacaagaagauga

SEQ ID NO: 918 - RNA, 23 nt, Artificial Sequence
  source: /note="Description of Artificial Sequence: Synthetic oligonucleotide"
uccccuagaaaauugagagaagu

SEQ ID NO: 919 - RNA, 23 nt, Artificial Sequence
  source: /note="Description of Artificial Sequence: Synthetic oligonucleotide"
ugagagaaguccaccacgagucu

SEQ ID NO: 920 - RNA, 23 nt, Artificial Sequence
  source: /note="Description of Artificial Sequence: Synthetic oligonucleotide"
cagaggugaagcgaagugcacac

SEQ ID NO: 921 - RNA, 23 nt, Artificial Sequence
  source: /note="Description of Artificial Sequence: Synthetic oligonucleotide"
auuuuugucaacaagaaaaaccc

SEQ ID NO: 922 - RNA, 23 nt, Artificial Sequence
  source: /note="Description of Artificial Sequence: Synthetic oligonucleotide"
uaacaagagaugauuaggcagag

SEQ ID NO: 923 - RNA, 23 nt, Artificial Sequence
  source: /note="Description of Artificial Sequence: Synthetic oligonucleotide"
uacucugugguauugugaggauu

SEQ ID NO: 924 - RNA, 23 nt, Artificial Sequence
  source: /note="Description of Artificial Sequence: Synthetic oligonucleotide"
uugaggauuuuugucaacaagaa

SEQ ID NO: 925 - RNA, 23 nt, Artificial Sequence
  source: /note="Description of Artificial Sequence: Synthetic oligonucleotide"
aaauugagagaaguccaccacga

SEQ ID NO: 926 - RNA, 23 nt, Artificial Sequence
  source: /note="Description of Artificial Sequence: Synthetic oligonucleotide"
aggcagaggugaaaaaguugcau

SEQ ID NO: 927 - RNA, 23 nt, Artificial Sequence
  source: /note="Description of Artificial Sequence: Synthetic oligonucleotide"
uaugcuguagcucuuguucccaa

SEQ ID NO: 928 - RNA, 23 nt, Artificial Sequence
  source: /note="Description of Artificial Sequence: Synthetic oligonucleotide"
uaagaaccaacaagaagaugagg

SEQ ID NO: 929 - RNA, 23 nt, Artificial Sequence
  source: /note="Description of Artificial Sequence: Synthetic oligonucleotide"
uaagaugaggcauagcagcagga

SEQ ID NO: 930 - RNA, 23 nt, Artificial Sequence
  source: /note="Description of Artificial Sequence: Synthetic oligonucleotide"
aacgccgcagacacauccaacga

SEQ ID NO: 931 - RNA, 23 nt, Artificial Sequence
  source: /note="Description of Artificial Sequence: Synthetic oligonucleotide"
uaggcauagcagcaggaugaaga

SEQ ID NO: 932 - RNA, 23 nt, Artificial Sequence
  source: /note="Description of Artificial Sequence: Synthetic oligonucleotide"
uaggauuuuugucaacaagaaaa

SEQ ID NO: 933 - RNA, 23 nt, Artificial Sequence
  source: /note="Description of Artificial Sequence: Synthetic oligonucleotide"
uaaaacgccgcagacacauccag

SEQ ID NO: 934 - RNA, 23 nt, Artificial Sequence
  source: /note="Description of Artificial Sequence: Synthetic oligonucleotide"
uaauaccacaucauccauauaac

SEQ ID NO: 935 - RNA, 23 nt, Artificial Sequence
  source: /note="Description of Artificial Sequence: Synthetic oligonucleotide"
gaggcauagcagcaggaugaaga

SEQ ID NO: 936 - RNA, 23 nt, Artificial Sequence
  source: /note="Description of Artificial Sequence: Synthetic oligonucleotide"
uagaggugaagcgaagugcacac

SEQ ID NO: 937 - RNA, 23 nt, Artificial Sequence
  source: /note="Description of Artificial Sequence: Synthetic oligonucleotide"
uauugugaggauuuuugucaaca

SEQ ID NO: 938 - RNA, 23 nt, Artificial Sequence
  source: /note="Description of Artificial Sequence: Synthetic oligonucleotide"
uuugcgucagcaaacacuuggca

SEQ ID NO: 939 - RNA, 23 nt, Artificial Sequence
  source: /note="Description of Artificial Sequence: Synthetic oligonucleotide"
uuugcgucagcaaacacuuggca

SEQ ID NO: 940 - RNA, 23 nt, Artificial Sequence
  source: /note="Description of Artificial Sequence: Synthetic oligonucleotide"
uaaggcacagcuuggaggcuuga

SEQ ID NO: 941 - RNA, 23 nt, Artificial Sequence
  source: /note="Description of Artificial Sequence: Synthetic oligonucleotide"
uauagcagcaggaugaagaggaa

SEQ ID NO: 942 - RNA, 23 nt, Artificial Sequence
  source: /note="Description of Artificial Sequence: Synthetic oligonucleotide"
aagaugaggcauagcagcaggau

SEQ ID NO: 943 - RNA, 23 nt, Artificial Sequence
  source: /note="Description of Artificial Sequence: Synthetic oligonucleotide"
agaagaaccaacaagaagaugag

SEQ ID NO: 944 - RNA, 23 nt, Artificial Sequence
  source: /note="Description of Artificial Sequence: Synthetic oligonucleotide"
uagaugagaaggcacagacgggg

SEQ ID NO: 945 - RNA, 23 nt, Artificial Sequence
  source: /note="Description of Artificial Sequence: Synthetic oligonucleotide"
agaaccaacaagaagaugaggca

SEQ ID NO: 946 - RNA, 23 nt, Artificial Sequence
  source: /note="Description of Artificial Sequence: Synthetic oligonucleotide"
uaagauaggggcauuuggugguc

SEQ ID NO: 947 - RNA, 23 nt, Artificial Sequence
  source: /note="Description of Artificial Sequence: Synthetic oligonucleotide"
aguauggaucggcagaggagcca

SEQ ID NO: 948 - RNA, 23 nt, Artificial Sequence
  source: /note="Description of Artificial Sequence: Synthetic oligonucleotide"
ugagagaaguccaccacgagucu

SEQ ID NO: 949 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 950 - RNA, 23 nt, Artificial Sequence
  source: /note="Description of Artificial Sequence: Synthetic oligonucleotide"
ugagagaaguccaccacgagucu

SEQ ID NO: 951 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 952 - RNA, 23 nt, Artificial Sequence
  source: /note="Description of Artificial Sequence: Synthetic oligonucleotide"
ugagagaaguccaccacgagucu

SEQ ID NO: 953 - RNA, 23 nt, Artificial Sequence
  source: /note="Description of Artificial Sequence: Synthetic oligonucleotide"
ugagagaaguccaccacgagucu

SEQ ID NO: 954 - RNA, 23 nt, Artificial Sequence
  source: /note="Description of Artificial Sequence: Synthetic oligonucleotide"
ugagagaaguccaccacgagucu

SEQ ID NO: 955 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 956 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 957 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 958 - RNA, 23 nt, Artificial Sequence
  source: /note="Description of Artificial Sequence: Synthetic oligonucleotide"
ugagagaaguccaccacgagucu

SEQ ID NO: 959 - RNA, 23 nt, Artificial Sequence
  source: /note="Description of Artificial Sequence: Synthetic oligonucleotide"
ugagagaaguccaccacgagucu

SEQ ID NO: 960 - RNA, 23 nt, Artificial Sequence
  source: /note="Description of Artificial Sequence: Synthetic oligonucleotide"
ugagagaaguccaccacgagucu

SEQ ID NO: 961 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 962 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 963 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 964 - RNA, 23 nt, Artificial Sequence
  source: /note="Description of Artificial Sequence: Synthetic oligonucleotide"
ugagagaaguccaccacgagucu

SEQ ID NO: 965 - RNA, 23 nt, Artificial Sequence
  source: /note="Description of Artificial Sequence: Synthetic oligonucleotide"
ugagagaaguccaccacgagucu

SEQ ID NO: 966 - RNA, 23 nt, Artificial Sequence
  source: /note="Description of Artificial Sequence: Synthetic oligonucleotide"
ugagagaaguccaccacgagucu

SEQ ID NO: 967 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 968 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 969 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 970 - RNA, 23 nt, Artificial Sequence
  source: /note="Description of Artificial Sequence: Synthetic oligonucleotide"
ugagagaaguccaccacgagucu

SEQ ID NO: 971 - RNA, 23 nt, Artificial Sequence
  source: /note="Description of Artificial Sequence: Synthetic oligonucleotide"
ugagagaaguccaccacgagucu

SEQ ID NO: 972 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 973 - RNA, 23 nt, Artificial Sequence
  source: /note="Description of Artificial Sequence: Synthetic oligonucleotide"
ugagagaaguccaccacgagucu

SEQ ID NO: 974 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 975 - RNA, 23 nt, Artificial Sequence
  source: /note="Description of Artificial Sequence: Synthetic oligonucleotide"
ugagagaaguccaccacgagucu

SEQ ID NO: 976 - RNA, 23 nt, Artificial Sequence
  source: /note="Description of Artificial Sequence: Synthetic oligonucleotide"
ugagagaaguccaccacgagucu

SEQ ID NO: 977 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 978 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 979 - RNA, 23 nt, Artificial Sequence
  source: /note="Description of Artificial Sequence: Synthetic oligonucleotide"
ugagagaaguccaccacgagucu

SEQ ID NO: 980 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 981 - RNA, 23 nt, Artificial Sequence
  source: /note="Description of Artificial Sequence: Synthetic oligonucleotide"
ugagagaaguccaccacgagucu

SEQ ID NO: 982 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 983 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 984 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 985 - RNA, 23 nt, Artificial Sequence
  source: /note="Description of Artificial Sequence: Synthetic oligonucleotide"
ugagagaaguccaccacgagucu

SEQ ID NO: 986 - RNA, 23 nt, Artificial Sequence
  source: /note="Description of Artificial Sequence: Synthetic oligonucleotide"
ugagagaaguccaccacgagucu

SEQ ID NO: 987 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 988 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 989 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 990 - RNA, 23 nt, Artificial Sequence
  source: /note="Description of Artificial Sequence: Synthetic oligonucleotide"
ugagagaaguccaccacgagucu

SEQ ID NO: 991 - RNA, 21 nt, Artificial Sequence
  source: /note="Description of Artificial Sequence: Synthetic oligonucleotide"
aguuauauggaugauguggua

SEQ ID NO: 992 - RNA, 21 nt, Artificial Sequence
  source: /note="Description of Artificial Sequence: Synthetic oligonucleotide"
ggaugugucugcggcguuuua

SEQ ID NO: 993 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nacucgugguggacuucucuca

SEQ ID NO: 994 - RNA, 21 nt, Artificial Sequence
  source: /note="Description of Artificial Sequence: Synthetic oligonucleotide"
acucgugguggacuucucuca

SEQ ID NO: 995 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 996 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 997 - RNA, 21 nt, Artificial Sequence
  source: /note="Description of Artificial Sequence: Synthetic oligonucleotide"
acucgugguggacuucucuca

SEQ ID NO: 998 - RNA, 19 nt, Artificial Sequence
  source: /note="Description of Artificial Sequence: Synthetic oligonucleotide"
ucgugguggacuucucuca

SEQ ID NO: 999 - RNA, 21 nt, Artificial Sequence
  source: /note="Description of Artificial Sequence: Synthetic oligonucleotide"
acucgugguggacuucucuca

SEQ ID NO: 1000 - RNA, 21 nt, Artificial Sequence
  source: /note="Description of Artificial Sequence: Synthetic oligonucleotide"
acucgugguggacuucucuca

SEQ ID NO: 1001 - RNA, 21 nt, Artificial Sequence
  source: /note="Description of Artificial Sequence: Synthetic oligonucleotide"
acucgugguggacuucucuca

SEQ ID NO: 1002 - RNA, 21 nt, Artificial Sequence
  source: /note="Description of Artificial Sequence: Synthetic oligonucleotide"
acucgugguggacuucucuca

SEQ ID NO: 1003 - RNA, 17 nt, Artificial Sequence
  source: /note="Description of Artificial Sequence: Synthetic oligonucleotide"
gugguggacuucucuca

SEQ ID NO: 1004 - RNA, 21 nt, Artificial Sequence
  source: /note="Description of Artificial Sequence: Synthetic oligonucleotide"
acucgugguggacuucucuca

SEQ ID NO: 1005 - RNA, 23 nt, Artificial Sequence
  source: /note="Description of Artificial Sequence: Synthetic oligonucleotide"
  modified_base (1)..(1): 2-hydroxymethyl-tetrahydrofurane-5-phosphate
  modified_base (23)..(23): 2-hydroxymethyl-tetrahydrofurane-5-phosphate
nucgugguggacuucucucauun

SEQ ID NO: 1006 - RNA, 21 nt, Artificial Sequence
  source: /note="Description of Artificial Sequence: Synthetic oligonucleotide"
acucgugguggacuucucuca

SEQ ID NO: 1007 - RNA, 21 nt, Artificial Sequence
  source: /note="Description of Artificial Sequence: Synthetic oligonucleotide"
acucgugguggacuucucuca

SEQ ID NO: 1008 - RNA, 21 nt, Artificial Sequence
  source: /note="Description of Artificial Sequence: Synthetic oligonucleotide"
acucgugguggacuucucuca

SEQ ID NO: 1009 - RNA, 21 nt, Artificial Sequence
  source: /note="Description of Artificial Sequence: Synthetic oligonucleotide"
acucgugguggacuucucuca

SEQ ID NO: 1010 - RNA, 21 nt, Artificial Sequence
  source: /note="Description of Artificial Sequence: Synthetic oligonucleotide"
  modified_base (1)..(1): 2-hydroxymethyl-tetrahydrofurane-5-phosphate
  modified_base (21)..(21): 2-hydroxymethyl-tetrahydrofurane-5-phosphate
nucgugguggacuucucucan

SEQ ID NO: 1011 - RNA, 21 nt, Artificial Sequence
  source: /note="Description of Artificial Sequence: Synthetic oligonucleotide"
acucgugguggacuucucuca

SEQ ID NO: 1012 - RNA, 21 nt, Artificial Sequence
  source: /note="Description of Artificial Sequence: Synthetic oligonucleotide"
acucgugguggacuucucuca

SEQ ID NO: 1013 - RNA, 21 nt, Artificial Sequence
  source: /note="Description of Artificial Sequence: Synthetic oligonucleotide"
acucgugguggacuucucuca

SEQ ID NO: 1014 - RNA, 17 nt, Artificial Sequence
  source: /note="Description of Artificial Sequence: Synthetic oligonucleotide"
uauuuccuaggguacaa

SEQ ID NO: 1015 - RNA, 21 nt, Artificial Sequence
  source: /note="Description of Artificial Sequence: Synthetic oligonucleotide"
acucgugguggacuucucuca

SEQ ID NO: 1016 - RNA, 21 nt, Artificial Sequence
  source: /note="Description of Artificial Sequence: Synthetic oligonucleotide"
  modified_base (1)..(1): 2-hydroxymethyl-tetrahydrofurane-5-phosphate
  modified_base (21)..(21): 2-hydroxymethyl-tetrahydrofurane-5-phosphate
nucgugguggacuucucucan

SEQ ID NO: 1017 - RNA, 21 nt, Artificial Sequence
  source: /note="Description of Artificial Sequence: Synthetic oligonucleotide"
acucgugguggacuucucuca

SEQ ID NO: 1018 - RNA, 21 nt, Artificial Sequence
  source: /note="Description of Artificial Sequence: Synthetic oligonucleotide"
acucgugguggacuucucuca

SEQ ID NO: 1019 - RNA, 21 nt, Artificial Sequence
  source: /note="Description of Artificial Sequence: Synthetic oligonucleotide"
acucgugguggacuucucuca

SEQ ID NO: 1020 - RNA, 21 nt, Artificial Sequence
  source: /note="Description of Artificial Sequence: Synthetic oligonucleotide"
acucgugguggacuucucuca

SEQ ID NO: 1021 - RNA, 21 nt, Artificial Sequence
  source: /note="Description of Artificial Sequence: Synthetic oligonucleotide"
acucgugguggacuucucuca

SEQ ID NO: 1022 - RNA, 21 nt, Artificial Sequence
  source: /note="Description of Artificial Sequence: Synthetic oligonucleotide"
acucgugguggacuucucuca

SEQ ID NO: 1023 - RNA, 21 nt, Artificial Sequence
  source: /note="Description of Artificial Sequence: Synthetic oligonucleotide"
acucgugguggacuucucuca

SEQ ID NO: 1024 - RNA, 21 nt, Artificial Sequence
  source: /note="Description of Artificial Sequence: Synthetic oligonucleotide"
acucgugguggacuucucuca

SEQ ID NO: 1025 - RNA, 21 nt, Artificial Sequence
  source: /note="Description of Artificial Sequence: Synthetic oligonucleotide"
acucgugguggacuucucuca

SEQ ID NO: 1026 - RNA, 21 nt, Artificial Sequence
  source: /note="Description of Artificial Sequence: Synthetic oligonucleotide"
acucgugguggacuucucuca

SEQ ID NO: 1027 - RNA, 21 nt, Artificial Sequence
  source: /note="Description of Artificial Sequence: Synthetic oligonucleotide"
acucgugguggacuucucuca

SEQ ID NO: 1028 - RNA, 21 nt, Artificial Sequence
  source: /note="Description of Artificial Sequence: Synthetic oligonucleotide"
acucgugguggacuucucuca

SEQ ID NO: 1029 - RNA, 21 nt, Artificial Sequence
  source: /note="Description of Artificial Sequence: Synthetic oligonucleotide"
acucgugguggacuucucuca

SEQ ID NO: 1030 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuucucuca

SEQ ID NO: 1031 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 1032 - RNA, 21 nt, Artificial Sequence
  source: /note="Description of Artificial Sequence: Synthetic oligonucleotide"
acucgugguggacuucucuca

SEQ ID NO: 1033 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 1034 - RNA, 21 nt, Artificial Sequence
  source: /note="Description of Artificial Sequence: Synthetic oligonucleotide"
acucgugguggacuucucuca

SEQ ID NO: 1035 - RNA, 21 nt, Artificial Sequence
  source: /note="Description of Artificial Sequence: Synthetic oligonucleotide"
acucgugguggacuucucuca

SEQ ID NO: 1036 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 1037 - RNA, 21 nt, Artificial Sequence
  source: /note="Description of Artificial Sequence: Synthetic oligonucleotide"
acucgugguggacuucucuca

SEQ ID NO: 1038 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 1039 - RNA, 21 nt, Artificial Sequence
  source: /note="Description of Artificial Sequence: Synthetic oligonucleotide"
acucgugguggacuucucuca

SEQ ID NO: 1040 - RNA, 21 nt, Artificial Sequence
  source: /note="Description of Artificial Sequence: Synthetic oligonucleotide"
gugguggacuucucucaauuu

SEQ ID NO: 1041 - RNA, 21 nt, Artificial Sequence
  source: /note="Description of Artificial Sequence: Synthetic oligonucleotide"
gugguggacuucucucaauuu

SEQ ID NO: 1042 - RNA, 21 nt, Artificial Sequence
  source: /note="Description of Artificial Sequence: Synthetic oligonucleotide"
gugguggacuucucucaauuu

SEQ ID NO: 1043 - RNA, 17 nt, Artificial Sequence
  source: /note="Description of Artificial Sequence: Synthetic oligonucleotide"
uggacuucucucaauuu

SEQ ID NO: 1044 - RNA, 21 nt, Artificial Sequence
  source: /note="Description of Artificial Sequence: Synthetic oligonucleotide"
gugguggacuucucucaauuu

SEQ ID NO: 1045 - RNA, 23 nt, Artificial Sequence
  source: /note="Description of Artificial Sequence: Synthetic oligonucleotide"
  modified_base (1)..(1): 2-hydroxymethyl-tetrahydrofurane-5-phosphate
  modified_base (23)..(23): 2-hydroxymethyl-tetrahydrofurane-5-phosphate
ngguggacuucucucaauuuuun

SEQ ID NO: 1046 - RNA, 21 nt, Artificial Sequence
  source: /note="Description of Artificial Sequence: Synthetic oligonucleotide"
gugguggacuucucucaauuu

SEQ ID NO: 1047 - RNA, 21 nt, Artificial Sequence
  source: /note="Description of Artificial Sequence: Synthetic oligonucleotide"
gugguggacuucucucaauuu

SEQ ID NO: 1048 - RNA, 21 nt, Artificial Sequence
  source: /note="Description of Artificial Sequence: Synthetic oligonucleotide"
gugguggacuucucucaauuu

SEQ ID NO: 1049 - RNA, 19 nt, Artificial Sequence
  source: /note="Description of Artificial Sequence: Synthetic oligonucleotide"
gguggacuucucucaauuu

SEQ ID NO: 1050 - RNA, 21 nt, Artificial Sequence
  source: /note="Description of Artificial Sequence: Synthetic oligonucleotide"
gugguggacuucucucaauuu

SEQ ID NO: 1051 - RNA, 21 nt, Artificial Sequence
  source: /note="Description of Artificial Sequence: Synthetic oligonucleotide"
  modified_base (1)..(1): 2-hydroxymethyl-tetrahydrofurane-5-phosphate
  modified_base (21)..(21): 2-hydroxymethyl-tetrahydrofurane-5-phosphate
ngguggacuucucucaauuun

SEQ ID NO: 1052 - RNA, 21 nt, Artificial Sequence
  source: /note="Description of Artificial Sequence: Synthetic oligonucleotide"
gugguggacuucucucaauuu

SEQ ID NO: 1053 - RNA, 21 nt, Artificial Sequence
  source: /note="Description of Artificial Sequence: Synthetic oligonucleotide"
gugguggacuucucucaauuu

SEQ ID NO: 1054 - RNA, 17 nt, Artificial Sequence
  source: /note="Description of Artificial Sequence: Synthetic oligonucleotide"
uggacuucucucaauuu

SEQ ID NO: 1055 - RNA, 21 nt, Artificial Sequence
  source: /note="Description of Artificial Sequence: Synthetic oligonucleotide"
gugguggacuucucucaauuu

SEQ ID NO: 1056 - RNA, 21 nt, Artificial Sequence
  source: /note="Description of Artificial Sequence: Synthetic oligonucleotide"
  modified_base (1)..(1): 2-hydroxymethyl-tetrahydrofurane-5-phosphate
  modified_base (21)..(21): 2-hydroxymethyl-tetrahydrofurane-5-phosphate
ngguggacuucucucaauuun

SEQ ID NO: 1057 - RNA, 21 nt, Artificial Sequence
  source: /note="Description of Artificial Sequence: Synthetic oligonucleotide"
gugguggacuucucucaauuu

SEQ ID NO: 1058 - RNA, 21 nt, Artificial Sequence
  source: /note="Description of Artificial Sequence: Synthetic oligonucleotide"
gugguggacuucucucaauuu

SEQ ID NO: 1059 - RNA, 21 nt, Artificial Sequence
  source: /note="Description of Artificial Sequence: Synthetic oligonucleotide"
gugguggacuucucucaauuu

SEQ ID NO: 1060 - RNA, 21 nt, Artificial Sequence
  source: /note="Description of Artificial Sequence: Synthetic oligonucleotide"
gugguggacuucucucaauuu

SEQ ID NO: 1061 - RNA, 21 nt, Artificial Sequence
  source: /note="Description of Artificial Sequence: Synthetic oligonucleotide"
gugguggacuucucucaauuu

SEQ ID NO: 1062 - RNA, 21 nt, Artificial Sequence
  source: /note="Description of Artificial Sequence: Synthetic oligonucleotide"
gugguggacuucucucaauuu

SEQ ID NO: 1063 - RNA, 21 nt, Artificial Sequence
  source: /note="Description of Artificial Sequence: Synthetic oligonucleotide"
gugguggacuucucucaauuu

SEQ ID NO: 1064 - RNA, 21 nt, Artificial Sequence
  source: /note="Description of Artificial Sequence: Synthetic oligonucleotide"
gugguggacuucucucaauuu

SEQ ID NO: 1065 - RNA, 21 nt, Artificial Sequence
  source: /note="Description of Artificial Sequence: Synthetic oligonucleotide"
gugguggacuucucucaauuu

SEQ ID NO: 1066 - RNA, 21 nt, Artificial Sequence
  source: /note="Description of Artificial Sequence: Synthetic oligonucleotide"
gugguggacuucucucaauuu

SEQ ID NO: 1067 - RNA, 21 nt, Artificial Sequence
  source: /note="Description of Artificial Sequence: Synthetic oligonucleotide"
gugguggacuucucucaauuu

SEQ ID NO: 1068 - RNA, 21 nt, Artificial Sequence
  source: /note="Description of Artificial Sequence: Synthetic oligonucleotide"
gugguggacuucucucaauuu

SEQ ID NO: 1069 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugguggacttcucucaauuu

SEQ ID NO: 1070 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ngugguggacuucucucaauuu

SEQ ID NO: 1071 - RNA, 21 nt, Artificial Sequence
  source: /note="Description of Artificial Sequence: Synthetic oligonucleotide"
gugguggacuucucucaauuu

SEQ ID NO: 1072 - RNA, 21 nt, Artificial Sequence
  source: /note="Description of Artificial Sequence: Synthetic oligonucleotide"
gugguggacuucucucaauuu

SEQ ID NO: 1073 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugguggacutcucucaauuu

SEQ ID NO: 1074 - RNA, 21 nt, Artificial Sequence
  source: /note="Description of Artificial Sequence: Synthetic oligonucleotide"
gugguggacuucucucaauuu

SEQ ID NO: 1075 - RNA, 21 nt, Artificial Sequence
  source: /note="Description of Artificial Sequence: Synthetic oligonucleotide"
gugguggacuucucucaauuu

SEQ ID NO: 1076 - RNA, 21 nt, Artificial Sequence
  source: /note="Description of Artificial Sequence: Synthetic oligonucleotide"
gugguggacuucucucaauuu

SEQ ID NO: 1077 - RNA, 21 nt, Artificial Sequence
  source: /note="Description of Artificial Sequence: Synthetic oligonucleotide"
gugguggacuucucucaauuu

SEQ ID NO: 1078 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugguggacutcucucaauuu

SEQ ID NO: 1079 - RNA, 21 nt, Artificial Sequence
  source: /note="Description of Artificial Sequence: Synthetic oligonucleotide"
gugguggacuucucucaauuu

SEQ ID NO: 1080 - RNA, 21 nt, Artificial Sequence
  source: /note="Description of Artificial Sequence: Synthetic oligonucleotide"
gugguggacuucucucaauuu

SEQ ID NO: 1081 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gugguggacutcucucaauuu

SEQ ID NO: 1082 - RNA, 21 nt, Artificial Sequence
  source: /note="Description of Artificial Sequence: Synthetic oligonucleotide"
gugguggacuucucucaauuu

SEQ ID NO: 1083 - RNA, 19 nt, Artificial Sequence
  source: /note="Description of Artificial Sequence: Synthetic oligonucleotide"
gguggacuucucucaauuu

SEQ ID NO: 1084 - RNA, 21 nt, Artificial Sequence
  source: /note="Description of Artificial Sequence: Synthetic oligonucleotide"
gugguggacuucucucaauuu

SEQ ID NO: 1085 - RNA, 21 nt, Artificial Sequence
  source: /note="Description of Artificial Sequence: Synthetic oligonucleotide"
gugcacuucgcuucaccucug

SEQ ID NO: 1086 - RNA, 21 nt, Artificial Sequence
  source: /note="Description of Artificial Sequence: Synthetic oligonucleotide"
guugacaaaaauccucacaau

SEQ ID NO: 1087 - RNA, 21 nt, Artificial Sequence
  source: /note="Description of Artificial Sequence: Synthetic oligonucleotide"
uguugacaaaaauccucacaa

SEQ ID NO: 1088 - RNA, 21 nt, Artificial Sequence
  source: /note="Description of Artificial Sequence: Synthetic oligonucleotide"
gguggacuucucucaauuuua

SEQ ID NO: 1089 - RNA, 21 nt, Artificial Sequence
  source: /note="Description of Artificial Sequence: Synthetic oligonucleotide"
ucuuuuggaguguggauucga

SEQ ID NO: 1090 - RNA, 21 nt, Artificial Sequence
  source: /note="Description of Artificial Sequence: Synthetic oligonucleotide"
ucuuuuggaguguggauucga

SEQ ID NO: 1091 - RNA, 21 nt, Artificial Sequence
  source: /note="Description of Artificial Sequence: Synthetic oligonucleotide"
acuguucaagccuccaagcua

SEQ ID NO: 1092 - RNA, 21 nt, Artificial Sequence
  source: /note="Description of Artificial Sequence: Synthetic oligonucleotide"
ucugccgauccauacugcgga

SEQ ID NO: 1093 - RNA, 21 nt, Artificial Sequence
  source: /note="Description of Artificial Sequence: Synthetic oligonucleotide"
augugucugcggcguuuuaua

SEQ ID NO: 1094 - RNA, 21 nt, Artificial Sequence
  source: /note="Description of Artificial Sequence: Synthetic oligonucleotide"
ccccgucugugccuucucaua

SEQ ID NO: 1095 - RNA, 21 nt, Artificial Sequence
  source: /note="Description of Artificial Sequence: Synthetic oligonucleotide"
gccuaaucaucucuuguucau

SEQ ID NO: 1096 - RNA, 21 nt, Artificial Sequence
  source: /note="Description of Artificial Sequence: Synthetic oligonucleotide"
ucuagacucgugguggacuuc

SEQ ID NO: 1097 - RNA, 21 nt, Artificial Sequence
  source: /note="Description of Artificial Sequence: Synthetic oligonucleotide"
cugccgauccauacugcggaa

SEQ ID NO: 1098 - RNA, 21 nt, Artificial Sequence
  source: /note="Description of Artificial Sequence: Synthetic oligonucleotide"
uuuuucuuguugacaaaaaua

SEQ ID NO: 1099 - RNA, 21 nt, Artificial Sequence
  source: /note="Description of Artificial Sequence: Synthetic oligonucleotide"
aucuucuuguugguucuucua

SEQ ID NO: 1100 - RNA, 21 nt, Artificial Sequence
  source: /note="Description of Artificial Sequence: Synthetic oligonucleotide"
guuuuucuuguugacaaaaau

SEQ ID NO: 1101 - RNA, 21 nt, Artificial Sequence
  source: /note="Description of Artificial Sequence: Synthetic oligonucleotide"
cugccuaaucaucucuuguua

SEQ ID NO: 1102 - RNA, 21 nt, Artificial Sequence
  source: /note="Description of Artificial Sequence: Synthetic oligonucleotide"
uccucacaauaccacagagua

SEQ ID NO: 1103 - RNA, 21 nt, Artificial Sequence
  source: /note="Description of Artificial Sequence: Synthetic oligonucleotide"
cuuguugacaaaaauccucaa

SEQ ID NO: 1104 - RNA, 21 nt, Artificial Sequence
  source: /note="Description of Artificial Sequence: Synthetic oligonucleotide"
gcaacuuuuucaccucugccu

SEQ ID NO: 1105 - RNA, 21 nt, Artificial Sequence
  source: /note="Description of Artificial Sequence: Synthetic oligonucleotide"
gggaacaagagcuacagcaua

SEQ ID NO: 1106 - RNA, 21 nt, Artificial Sequence
  source: /note="Description of Artificial Sequence: Synthetic oligonucleotide"
cgugguggacuucucucaauu

SEQ ID NO: 1107 - RNA, 21 nt, Artificial Sequence
  source: /note="Description of Artificial Sequence: Synthetic oligonucleotide"
cugcugcuaugccucaucuua

SEQ ID NO: 1108 - RNA, 21 nt, Artificial Sequence
  source: /note="Description of Artificial Sequence: Synthetic oligonucleotide"
guuggaugugucugcggcguu

SEQ ID NO: 1109 - RNA, 21 nt, Artificial Sequence
  source: /note="Description of Artificial Sequence: Synthetic oligonucleotide"
uucauccugcugcuaugccua

SEQ ID NO: 1110 - RNA, 21 nt, Artificial Sequence
  source: /note="Description of Artificial Sequence: Synthetic oligonucleotide"
uucuuguugacaaaaauccua

SEQ ID NO: 1111 - RNA, 21 nt, Artificial Sequence
  source: /note="Description of Artificial Sequence: Synthetic oligonucleotide"
uauauggaugaugugguauua

SEQ ID NO: 1112 - RNA, 21 nt, Artificial Sequence
  source: /note="Description of Artificial Sequence: Synthetic oligonucleotide"
uucauccugcugcuaugccuc

SEQ ID NO: 1113 - RNA, 21 nt, Artificial Sequence
  source: /note="Description of Artificial Sequence: Synthetic oligonucleotide"
gugcacuucgcuucaccucua

SEQ ID NO: 1114 - RNA, 21 nt, Artificial Sequence
  source: /note="Description of Artificial Sequence: Synthetic oligonucleotide"
uugacaaaaauccucacaaua

SEQ ID NO: 1115 - RNA, 21 nt, Artificial Sequence
  source: /note="Description of Artificial Sequence: Synthetic oligonucleotide"
aagccuccaagcugugccuua

SEQ ID NO: 1116 - RNA, 21 nt, Artificial Sequence
  source: /note="Description of Artificial Sequence: Synthetic oligonucleotide"
ccucuucauccugcugcuaua

SEQ ID NO: 1117 - RNA, 21 nt, Artificial Sequence
  source: /note="Description of Artificial Sequence: Synthetic oligonucleotide"
ccugcugcuaugccucaucuu

SEQ ID NO: 1118 - RNA, 21 nt, Artificial Sequence
  source: /note="Description of Artificial Sequence: Synthetic oligonucleotide"
caucuucuuguugguucuucu

SEQ ID NO: 1119 - RNA, 21 nt, Artificial Sequence
  source: /note="Description of Artificial Sequence: Synthetic oligonucleotide"
ccgucugugccuucucaucua

SEQ ID NO: 1120 - RNA, 21 nt, Artificial Sequence
  source: /note="Description of Artificial Sequence: Synthetic oligonucleotide"
ccucaucuucuuguugguucu

SEQ ID NO: 1121 - RNA, 21 nt, Artificial Sequence
  source: /note="Description of Artificial Sequence: Synthetic oligonucleotide"
ccaccaaaugccccuaucuua

SEQ ID NO: 1122 - RNA, 21 nt, Artificial Sequence
  source: /note="Description of Artificial Sequence: Synthetic oligonucleotide"
gcuccucugccgauccauacu

SEQ ID NO: 1123 - RNA, 21 nt, Artificial Sequence
  source: /note="Description of Artificial Sequence: Synthetic oligonucleotide"
guugacaaaaauccucacaau

SEQ ID NO: 1124 - RNA, 21 nt, Artificial Sequence
  source: /note="Description of Artificial Sequence: Synthetic oligonucleotide"
uguugacaaaaauccucacaa

SEQ ID NO: 1125 - RNA, 21 nt, Artificial Sequence
  source: /note="Description of Artificial Sequence: Synthetic oligonucleotide"
gguggacuucucucaauuuua

SEQ ID NO: 1126 - RNA, 21 nt, Artificial Sequence
  source: /note="Description of Artificial Sequence: Synthetic oligonucleotide"
ucuuuuggaguguggauucga

SEQ ID NO: 1127 - RNA, 21 nt, Artificial Sequence
  source: /note="Description of Artificial Sequence: Synthetic oligonucleotide"
ucuuuuggaguguggauucga

SEQ ID NO: 1128 - RNA, 21 nt, Artificial Sequence
  source: /note="Description of Artificial Sequence: Synthetic oligonucleotide"
acuguucaagccuccaagcua

SEQ ID NO: 1129 - RNA, 21 nt, Artificial Sequence
  source: /note="Description of Artificial Sequence: Synthetic oligonucleotide"
ucugccgauccauacugcgga

SEQ ID NO: 1130 - RNA, 21 nt, Artificial Sequence
  source: /note="Description of Artificial Sequence: Synthetic oligonucleotide"
aguuauauggaugauguggua

SEQ ID NO: 1131 - RNA, 21 nt, Artificial Sequence
  source: /note="Description of Artificial Sequence: Synthetic oligonucleotide"
augugucugcggcguuuuaua

SEQ ID NO: 1132 - RNA, 21 nt, Artificial Sequence
  source: /note="Description of Artificial Sequence: Synthetic oligonucleotide"
ccccgucugugccuucucaua

SEQ ID NO: 1133 - RNA, 21 nt, Artificial Sequence
  source: /note="Description of Artificial Sequence: Synthetic oligonucleotide"
gccuaaucaucucuuguucau

SEQ ID NO: 1134 - RNA, 21 nt, Artificial Sequence
  source: /note="Description of Artificial Sequence: Synthetic oligonucleotide"
ucuagacucgugguggacuuc

SEQ ID NO: 1135 - RNA, 21 nt, Artificial Sequence
  source: /note="Description of Artificial Sequence: Synthetic oligonucleotide"
cugccgauccauacugcggaa

SEQ ID NO: 1136 - RNA, 21 nt, Artificial Sequence
  source: /note="Description of Artificial Sequence: Synthetic oligonucleotide"
aucuucuuguugguucuucua

SEQ ID NO: 1137 - RNA, 21 nt, Artificial Sequence
  source: /note="Description of Artificial Sequence: Synthetic oligonucleotide"
uucucucaauuuucuagggga

SEQ ID NO: 1138 - RNA, 21 nt, Artificial Sequence
  source: /note="Description of Artificial Sequence: Synthetic oligonucleotide"
acucgugguggacuucucuca

SEQ ID NO: 1139 - RNA, 21 nt, Artificial Sequence
  source: /note="Description of Artificial Sequence: Synthetic oligonucleotide"
gugcacuucgcuucaccucug

SEQ ID NO: 1140 - RNA, 21 nt, Artificial Sequence
  source: /note="Description of Artificial Sequence: Synthetic oligonucleotide"
guuuuucuuguugacaaaaau

SEQ ID NO: 1141 - RNA, 21 nt, Artificial Sequence
  source: /note="Description of Artificial Sequence: Synthetic oligonucleotide"
cugccuaaucaucucuuguua

SEQ ID NO: 1142 - RNA, 21 nt, Artificial Sequence
  source: /note="Description of Artificial Sequence: Synthetic oligonucleotide"
uccucacaauaccacagagua

SEQ ID NO: 1143 - RNA, 21 nt, Artificial Sequence
  source: /note="Description of Artificial Sequence: Synthetic oligonucleotide"
cuuguugacaaaaauccucaa

SEQ ID NO: 1144 - RNA, 21 nt, Artificial Sequence
  source: /note="Description of Artificial Sequence: Synthetic oligonucleotide"
gugguggacuucucucaauuu

SEQ ID NO: 1145 - RNA, 21 nt, Artificial Sequence
  source: /note="Description of Artificial Sequence: Synthetic oligonucleotide"
gcaacuuuuucaccucugccu

SEQ ID NO: 1146 - RNA, 21 nt, Artificial Sequence
  source: /note="Description of Artificial Sequence: Synthetic oligonucleotide"
gggaacaagagcuacagcaua

SEQ ID NO: 1147 - RNA, 21 nt, Artificial Sequence
  source: /note="Description of Artificial Sequence: Synthetic oligonucleotide"
ucaucuucuuguugguucuua

SEQ ID NO: 1148 - RNA, 21 nt, Artificial Sequence
  source: /note="Description of Artificial Sequence: Synthetic oligonucleotide"
cugcugcuaugccucaucuua

SEQ ID NO: 1149 - RNA, 21 nt, Artificial Sequence
  source: /note="Description of Artificial Sequence: Synthetic oligonucleotide"
guuggaugugucugcggcguu

SEQ ID NO: 1150 - RNA, 21 nt, Artificial Sequence
  source: /note="Description of Artificial Sequence: Synthetic oligonucleotide"
uucauccugcugcuaugccua

SEQ ID NO: 1151 - RNA, 21 nt, Artificial Sequence
  source: /note="Description of Artificial Sequence: Synthetic oligonucleotide"
uucuuguugacaaaaauccua

SEQ ID NO: 1152 - RNA, 21 nt, Artificial Sequence
  source: /note="Description of Artificial Sequence: Synthetic oligonucleotide"
ggaugugucugcggcguuuua

SEQ ID NO: 1153 - RNA, 21 nt, Artificial Sequence
  source: /note="Description of Artificial Sequence: Synthetic oligonucleotide"
uauauggaugaugugguauua

SEQ ID NO: 1154 - RNA, 21 nt, Artificial Sequence
  source: /note="Description of Artificial Sequence: Synthetic oligonucleotide"
uucauccugcugcuaugccuc

SEQ ID NO: 1155 - RNA, 21 nt, Artificial Sequence
  source: /note="Description of Artificial Sequence: Synthetic oligonucleotide"
gugcacuucgcuucaccucua

SEQ ID NO: 1156 - RNA, 21 nt, Artificial Sequence
  source: /note="Description of Artificial Sequence: Synthetic oligonucleotide"
uugacaaaaauccucacaaua

SEQ ID NO: 1157 - RNA, 21 nt, Artificial Sequence
  source: /note="Description of Artificial Sequence: Synthetic oligonucleotide"
ccaaguguuugcugacgcaaa

SEQ ID NO: 1158 - RNA, 21 nt, Artificial Sequence
  source: /note="Description of Artificial Sequence: Synthetic oligonucleotide"
ccaaguguuugcugacgcaaa

SEQ ID NO: 1159 - RNA, 21 nt, Artificial Sequence
  source: /note="Description of Artificial Sequence: Synthetic oligonucleotide"
aagccuccaagcugugccuua

SEQ ID NO: 1160 - RNA, 21 nt, Artificial Sequence
  source: /note="Description of Artificial Sequence: Synthetic oligonucleotide"
ccucuucauccugcugcuaua

SEQ ID NO: 1161 - RNA, 21 nt, Artificial Sequence
  source: /note="Description of Artificial Sequence: Synthetic oligonucleotide"
ccugcugcuaugccucaucuu

SEQ ID NO: 1162 - RNA, 21 nt, Artificial Sequence
  source: /note="Description of Artificial Sequence: Synthetic oligonucleotide"
caucuucuuguugguucuucu

SEQ ID NO: 1163 - RNA, 21 nt, Artificial Sequence
  source: /note="Description of Artificial Sequence: Synthetic oligonucleotide"
ccgucugugccuucucaucua

SEQ ID NO: 1164 - RNA, 21 nt, Artificial Sequence
  source: /note="Description of Artificial Sequence: Synthetic oligonucleotide"
ccucaucuucuuguugguucu

SEQ ID NO: 1165 - RNA, 21 nt, Artificial Sequence
  source: /note="Description of Artificial Sequence: Synthetic oligonucleotide"
ccaccaaaugccccuaucuua

SEQ ID NO: 1166 - RNA, 21 nt, Artificial Sequence
  source: /note="Description of Artificial Sequence: Synthetic oligonucleotide"
gcuccucugccgauccauacu

SEQ ID NO: 1167 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggugtacuucucuca

SEQ ID NO: 1168 - RNA, 21 nt, Artificial Sequence
  source: /note="Description of Artificial Sequence: Synthetic oligonucleotide"
acucgugguggacuucucuca

SEQ ID NO: 1169 - RNA, 21 nt, Artificial Sequence
  source: /note="Description of Artificial Sequence: Synthetic oligonucleotide"
acucgugguggacuucucuca

SEQ ID NO: 1170 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuucacuca

SEQ ID NO: 1171 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtgtacuucacuca

SEQ ID NO: 1172 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggugtacuucacuca

SEQ ID NO: 1173 - RNA, 21 nt, Artificial Sequence
  source: /note="Description of Artificial Sequence: Synthetic oligonucleotide"
acucgugguggacuucucuca

SEQ ID NO: 1174 - RNA, 21 nt, Artificial Sequence
  source: /note="Description of Artificial Sequence: Synthetic oligonucleotide"
acucgugguggacuucucuca

SEQ ID NO: 1175 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuuctcuca

SEQ ID NO: 1176 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuucucuca

SEQ ID NO: 1177 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuucucuca

SEQ ID NO: 1178 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtgtacuucacuca

SEQ ID NO: 1179 - RNA, 21 nt, Artificial Sequence
  source: /note="Description of Artificial Sequence: Synthetic oligonucleotide"
acucgugguggacuucucuca

SEQ ID NO: 1180 - RNA, 21 nt, Artificial Sequence
  source: /note="Description of Artificial Sequence: Synthetic oligonucleotide"
acucgugguggacuucucuca

SEQ ID NO: 1181 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuucacuca

SEQ ID NO: 1182 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuucacuca

SEQ ID NO: 1183 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuucucuca

SEQ ID NO: 1184 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuuctcuca

SEQ ID NO: 1185 - RNA, 21 nt, Artificial Sequence
  source: /note="Description of Artificial Sequence: Synthetic oligonucleotide"
acucgugguggacuucucuca

SEQ ID NO: 1186 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 1187 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtgtacuucacuca

SEQ ID NO: 1188 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuuctcuca

SEQ ID NO: 1189 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (17)..(17): 2-hydroxymethyl-tetrahydrofurane-4-methoxy-3-phosphate (abasic 2'-OMe furanose)
acucgugguggacuucncuca

SEQ ID NO: 1190 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 1191 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuuctcuca

SEQ ID NO: 1192 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuucucuca

SEQ ID NO: 1193 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuucacuca

SEQ ID NO: 1194 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuucacuca

SEQ ID NO: 1195 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuucacuca

SEQ ID NO: 1196 - RNA, 21 nt, Artificial Sequence
  source: /note="Description of Artificial Sequence: Synthetic oligonucleotide"
acucgugguggacuucucuca

SEQ ID NO: 1197 - DNA, 22 bp, Artificial Sequence
  source: /note="Description of Artificial Sequence: Synthetic oligonucleotide"
  source: /note="Description of Combined DNA/RNA Molecule: Synthetic oligonucleotide"
  modified_base (1)..(1): 2-hydroxymethyl-tetrahydrofurane-4-methoxy-3-phosphate (abasic 2'-OMe furanose)
nacucgugguggacuuctcuca

SEQ ID NO: 1198 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuucacuca

SEQ ID NO: 1199 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtgtacuucacuca

SEQ ID NO: 1200 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuucccuca

SEQ ID NO: 1201 - RNA, 21 nt, Artificial Sequence
  source: /note="Description of Artificial Sequence: Synthetic oligonucleotide"
acucgugguggacuucucuca

SEQ ID NO: 1202 - RNA, 21 nt, Artificial Sequence
  source: /note="Description of Artificial Sequence: Synthetic oligonucleotide"
acucgugguggacuucucuca

SEQ ID NO: 1203 - DNA, 22 bp, Artificial Sequence
  source: /note="Description of Artificial Sequence: Synthetic oligonucleotide"
  source: /note="Description of Combined DNA/RNA Molecule: Synthetic oligonucleotide"
  modified_base (1)..(1): 2-hydroxymethyl-tetrahydrofurane-4-methoxy-3-phosphate (abasic 2'-OMe furanose)
nacucgugguggacuuctcuca

SEQ ID NO: 1204 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuuctcuca

SEQ ID NO: 1205 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuucgcuca

SEQ ID NO: 1206 - RNA, 21 nt, Artificial Sequence
  source: /note="Description of Artificial Sequence: Synthetic oligonucleotide"
acucgugguggacuucucuca

SEQ ID NO: 1207 - RNA, 21 nt, Artificial Sequence
  source: /note="Description of Artificial Sequence: Synthetic oligonucleotide"
acucgugguggacuucucuca

SEQ ID NO: 1208 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucgugguggacuucucuca

SEQ ID NO: 1209 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acucguggtggacuucacuca

SEQ ID NO: 1210 - RNA, 23 nt, Artificial Sequence
  source: /note="Description of Artificial Sequence: Synthetic oligonucleotide"
uaccacaucauccauauaacuga

SEQ ID NO: 1211 - RNA, 23 nt, Artificial Sequence
  source: /note="Description of Artificial Sequence: Synthetic oligonucleotide"
uaaaacgccgcagacacauccag

SEQ ID NO: 1212 - RNA, 23 nt, Artificial Sequence
  source: /note="Description of Artificial Sequence: Synthetic oligonucleotide"
ugagagaaguccaccacgagucu

SEQ ID NO: 1213 - RNA, 23 nt, Artificial Sequence
  source: /note="Description of Artificial Sequence: Synthetic oligonucleotide"
ugagagaaguccaccacgagucu

SEQ ID NO: 1214 - RNA, 23 nt, Artificial Sequence
  source: /note="Description of Artificial Sequence: Synthetic oligonucleotide"
ugagagaaguccaccacgagucu

SEQ ID NO: 1215 - RNA, 23 nt, Artificial Sequence
  source: /note="Description of Artificial Sequence: Synthetic oligonucleotide"
ugagagaaguccaccacgagucu

SEQ ID NO: 1216 - RNA, 23 nt, Artificial Sequence
  source: /note="Description of Artificial Sequence: Synthetic oligonucleotide"
ugagagaaguccaccacgagucu

SEQ ID NO: 1217 - RNA, 21 nt, Artificial Sequence
  source: /note="Description of Artificial Sequence: Synthetic oligonucleotide"
ugagagaaguccaccacgagu

SEQ ID NO: 1218 - RNA, 23 nt, Artificial Sequence
  source: /note="Description of Artificial Sequence: Synthetic oligonucleotide"
ugagagaaguccaccacgagucu

SEQ ID NO: 1219 - RNA, 23 nt, Artificial Sequence
  source: /note="Description of Artificial Sequence: Synthetic oligonucleotide"
ugagagaaguccaccacgagucu

SEQ ID NO: 1220 - RNA, 23 nt, Artificial Sequence
  source: /note="Description of Artificial Sequence: Synthetic oligonucleotide"
ugagagaaguccaccacgagucu

SEQ ID NO: 1221 - RNA, 23 nt, Artificial Sequence
  source: /note="Description of Artificial Sequence: Synthetic oligonucleotide"
ugagagaaguccaccacgagucu

SEQ ID NO: 1222 - RNA, 19 nt, Artificial Sequence
  source: /note="Description of Artificial Sequence: Synthetic oligonucleotide"
ugagagaaguccaccacga

SEQ ID NO: 1223 - RNA, 23 nt, Artificial Sequence
  source: /note="Description of Artificial Sequence: Synthetic oligonucleotide"
ugagagaaguccaccacgagucu

SEQ ID NO: 1224 - RNA, 21 nt, Artificial Sequence
  source: /note="Description of Artificial Sequence: Synthetic oligonucleotide"
ugagagaaguccaccacgauu

SEQ ID NO: 1225 - RNA, 23 nt, Artificial Sequence
  source: /note="Description of Artificial Sequence: Synthetic oligonucleotide"
ugagagaaguccaccacgagucu

SEQ ID NO: 1226 - RNA, 23 nt, Artificial Sequence
  source: /note="Description of Artificial Sequence: Synthetic oligonucleotide"
ugagagaaguccaccacgagucu

SEQ ID NO: 1227 - RNA, 23 nt, Artificial Sequence
  source: /note="Description of Artificial Sequence: Synthetic oligonucleotide"
ugagagaaguccaccacgagucu

SEQ ID NO: 1228 - RNA, 23 nt, Artificial Sequence
  source: /note="Description of Artificial Sequence: Synthetic oligonucleotide"
ugagagaaguccaccacgagucu

SEQ ID NO: 1229 - RNA, 21 nt, Artificial Sequence
  source: /note="Description of Artificial Sequence: Synthetic oligonucleotide"
ugagagaaguccaccacgauu

SEQ ID NO: 1230 - RNA, 23 nt, Artificial Sequence
  source: /note="Description of Artificial Sequence: Synthetic oligonucleotide"
ugagagaaguccaccacgagucu

SEQ ID NO: 1231 - RNA, 23 nt, Artificial Sequence
  source: /note="Description of Artificial Sequence: Synthetic oligonucleotide"
ugagagaaguccaccacgagucu

SEQ ID NO: 1232 - RNA, 23 nt, Artificial Sequence
  source: /note="Description of Artificial Sequence: Synthetic oligonucleotide"
ugagagaaguccaccacgagucu

SEQ ID NO: 1233 - RNA, 19 nt, Artificial Sequence
  source: /note="Description of Artificial Sequence: Synthetic oligonucleotide"
ugagagaaguccaccacga

SEQ ID NO: 1234 - RNA, 23 nt, Artificial Sequence
  source: /note="Description of Artificial Sequence: Synthetic oligonucleotide"
ugagagaaguccaccacgagucu

SEQ ID NO: 1235 - RNA, 21 nt, Artificial Sequence
  source: /note="Description of Artificial Sequence: Synthetic oligonucleotide"
ugagagaaguccaccacgauu

SEQ ID NO: 1236 - RNA, 23 nt, Artificial Sequence
  source: /note="Description of Artificial Sequence: Synthetic oligonucleotide"
ugagagaaguccaccacgagucu

SEQ ID NO: 1237 - RNA, 23 nt, Artificial Sequence
  source: /note="Description of Artificial Sequence: Synthetic oligonucleotide"
ugagagaaguccaccacgagucu

SEQ ID NO: 1238 - RNA, 23 nt, Artificial Sequence
  source: /note="Description of Artificial Sequence: Synthetic oligonucleotide"
ugagagaaguccaccacgagucu

SEQ ID NO: 1239 - RNA, 23 nt, Artificial Sequence
  source: /note="Description of Artificial Sequence: Synthetic oligonucleotide"
ugagagaaguccaccacgagucu

SEQ ID NO: 1240 - RNA, 23 nt, Artificial Sequence
  source: /note="Description of Artificial Sequence: Synthetic oligonucleotide"
ugagagaaguccaccacgagucu

SEQ ID NO: 1241 - RNA, 23 nt, Artificial Sequence
  source: /note="Description of Artificial Sequence: Synthetic oligonucleotide"
ugagagaaguccaccacgagucu

SEQ ID NO: 1242 - RNA, 23 nt, Artificial Sequence
  source: /note="Description of Artificial Sequence: Synthetic oligonucleotide"
ugagagaaguccaccacgagucu

SEQ ID NO: 1243 - RNA, 23 nt, Artificial Sequence
  source: /note="Description of Artificial Sequence: Synthetic oligonucleotide"
ugagagaaguccaccacgagucu

SEQ ID NO: 1244 - RNA, 23 nt, Artificial Sequence
  source: /note="Description of Artificial Sequence: Synthetic oligonucleotide"
ugagagaaguccaccacgagucu

SEQ ID NO: 1245 - RNA, 23 nt, Artificial Sequence
  source: /note="Description of Artificial Sequence: Synthetic oligonucleotide"
ugagagaaguccaccacgagucu

SEQ ID NO: 1246 - RNA, 23 nt, Artificial Sequence
  source: /note="Description of Artificial Sequence: Synthetic oligonucleotide"
ugagagaaguccaccacgagucu

SEQ ID NO: 1247 - RNA, 23 nt, Artificial Sequence
  source: /note="Description of Artificial Sequence: Synthetic oligonucleotide"
ugagagaaguccaccacgagucu

SEQ ID NO: 1248 - RNA, 23 nt, Artificial Sequence
  source: /note="Description of Artificial Sequence: Synthetic oligonucleotide"
ugagagaaguccaccacgagucu

SEQ ID NO: 1249 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1250 - RNA, 23 nt, Artificial Sequence
  source: /note="Description of Artificial Sequence: Synthetic oligonucleotide"
ugagagaaguccaccacgagucu

SEQ ID NO: 1251 - RNA, 23 nt, Artificial Sequence
  source: /note="Description of Artificial Sequence: Synthetic oligonucleotide"
ugagagaaguccaccacgagucu

SEQ ID NO: 1252 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaaguccaccacgagucu

SEQ ID NO: 1253 - RNA, 23 nt, Artificial Sequence
  source: /note="Description of Artificial Sequence: Synthetic oligonucleotide"
ugagagaaguccaccacgagucu

SEQ ID NO: 1254 - RNA, 23 nt, Artificial Sequence
  source: /note="Description of Artificial Sequence: Synthetic oligonucleotide"
ugagagaaguccaccacgagucu

SEQ ID NO: 1255 - RNA, 23 nt, Artificial Sequence
  source: /note="Description of Artificial Sequence: Synthetic oligonucleotide"
ugagagaaguccaccacgagucu

SEQ ID NO: 1256 - RNA, 23 nt, Artificial Sequence
  source: /note="Description of Artificial Sequence: Synthetic oligonucleotide"
ugagagaaguccaccacgagucu

SEQ ID NO: 1257 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaaguccaccacgagucu

SEQ ID NO: 1258 - RNA, 23 nt, Artificial Sequence
  source: /note="Description of Artificial Sequence: Synthetic oligonucleotide"
ugagagaaguccaccacgagucu

SEQ ID NO: 1259 - RNA, 23 nt, Artificial Sequence
  source: /note="Description of Artificial Sequence: Synthetic oligonucleotide"
aaauugagagaaguccaccacga

SEQ ID NO: 1260 - RNA, 23 nt, Artificial Sequence
  source: /note="Description of Artificial Sequence: Synthetic oligonucleotide"
aaauugagagaaguccaccacga

SEQ ID NO: 1261 - RNA, 23 nt, Artificial Sequence
  source: /note="Description of Artificial Sequence: Synthetic oligonucleotide"
aaauugagagaaguccaccacga

SEQ ID NO: 1262 - RNA, 19 nt, Artificial Sequence
  source: /note="Description of Artificial Sequence: Synthetic oligonucleotide"
aaauugagagaaguccacc

SEQ ID NO: 1263 - RNA, 23 nt, Artificial Sequence
  source: /note="Description of Artificial Sequence: Synthetic oligonucleotide"
aaauugagagaaguccaccacga

SEQ ID NO: 1264 - RNA, 21 nt, Artificial Sequence
  source: /note="Description of Artificial Sequence: Synthetic oligonucleotide"
aaauugagagaaguccaccuu

SEQ ID NO: 1265 - RNA, 23 nt, Artificial Sequence
  source: /note="Description of Artificial Sequence: Synthetic oligonucleotide"
aaauugagagaaguccaccacga

SEQ ID NO: 1266 - RNA, 23 nt, Artificial Sequence
  source: /note="Description of Artificial Sequence: Synthetic oligonucleotide"
aaauugagagaaguccaccacga

SEQ ID NO: 1267 - RNA, 23 nt, Artificial Sequence
  source: /note="Description of Artificial Sequence: Synthetic oligonucleotide"
aaauugagagaaguccaccacga

SEQ ID NO: 1268 - RNA, 21 nt, Artificial Sequence
  source: /note="Description of Artificial Sequence: Synthetic oligonucleotide"
aaauugagagaaguccaccac

SEQ ID NO: 1269 - RNA, 23 nt, Artificial Sequence
  source: /note="Description of Artificial Sequence: Synthetic oligonucleotide"
aaauugagagaaguccaccacga

SEQ ID NO: 1270 - RNA, 21 nt, Artificial Sequence
  source: /note="Description of Artificial Sequence: Synthetic oligonucleotide"
aaauugagagaaguccaccuu

SEQ ID NO: 1271 - RNA, 23 nt, Artificial Sequence
  source: /note="Description of Artificial Sequence: Synthetic oligonucleotide"
aaauugagagaaguccaccacga

SEQ ID NO: 1272 - RNA, 23 nt, Artificial Sequence
  source: /note="Description of Artificial Sequence: Synthetic oligonucleotide"
aaauugagagaaguccaccacga

SEQ ID NO: 1273 - RNA, 19 nt, Artificial Sequence
  source: /note="Description of Artificial Sequence: Synthetic oligonucleotide"
aaauugagagaaguccacc

SEQ ID NO: 1274 - RNA, 23 nt, Artificial Sequence
  source: /note="Description of Artificial Sequence: Synthetic oligonucleotide"
aaauugagagaaguccaccacga

SEQ ID NO: 1275 - RNA, 21 nt, Artificial Sequence
  source: /note="Description of Artificial Sequence: Synthetic oligonucleotide"
aaauugagagaaguccaccuu

SEQ ID NO: 1276 - RNA, 23 nt, Artificial Sequence
  source: /note="Description of Artificial Sequence: Synthetic oligonucleotide"
aaauugagagaaguccaccacga

SEQ ID NO: 1277 - RNA, 23 nt, Artificial Sequence
  source: /note="Description of Artificial Sequence: Synthetic oligonucleotide"
aaauugagagaaguccaccacga

SEQ ID NO: 1278 - RNA, 23 nt, Artificial Sequence
  source: /note="Description of Artificial Sequence: Synthetic oligonucleotide"
aaauugagagaaguccaccacga

SEQ ID NO: 1279 - RNA, 23 nt, Artificial Sequence
  source: /note="Description of Artificial Sequence: Synthetic oligonucleotide"
aaauugagagaaguccaccacga

SEQ ID NO: 1280 - RNA, 23 nt, Artificial Sequence
  source: /note="Description of Artificial Sequence: Synthetic oligonucleotide"
aaauugagagaaguccaccacga

SEQ ID NO: 1281 - RNA, 23 nt, Artificial Sequence
  source: /note="Description of Artificial Sequence: Synthetic oligonucleotide"
aaauugagagaaguccaccacga

SEQ ID NO: 1282 - RNA, 23 nt, Artificial Sequence
  source: /note="Description of Artificial Sequence: Synthetic oligonucleotide"
aaauugagagaaguccaccacga

SEQ ID NO: 1283 - RNA, 23 nt, Artificial Sequence
  source: /note="Description of Artificial Sequence: Synthetic oligonucleotide"
aaauugagagaaguccaccacga

SEQ ID NO: 1284 - RNA, 23 nt, Artificial Sequence
  source: /note="Description of Artificial Sequence: Synthetic oligonucleotide"
aaauugagagaaguccaccacga

SEQ ID NO: 1285 - RNA, 23 nt, Artificial Sequence
  source: /note="Description of Artificial Sequence: Synthetic oligonucleotide"
aaauugagagaaguccaccacga

SEQ ID NO: 1286 - RNA, 23 nt, Artificial Sequence
  source: /note="Description of Artificial Sequence: Synthetic oligonucleotide"
aaauugagagaaguccaccacga

SEQ ID NO: 1287 - RNA, 23 nt, Artificial Sequence
  source: /note="Description of Artificial Sequence: Synthetic oligonucleotide"
aaauugagagaaguccaccacga

SEQ ID NO: 1288 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauugagagaagtccaccacga

SEQ ID NO: 1289 - RNA, 23 nt, Artificial Sequence
  source: /note="Description of Artificial Sequence: Synthetic oligonucleotide"
aaauugagagaaguccaccacga

SEQ ID NO: 1290 - RNA, 23 nt, Artificial Sequence
  source: /note="Description of Artificial Sequence: Synthetic oligonucleotide"
aaauugagagaaguccaccacga

SEQ ID NO: 1291 - RNA, 23 nt, Artificial Sequence
  source: /note="Description of Artificial Sequence: Synthetic oligonucleotide"
aaauugagagaaguccaccacga

SEQ ID NO: 1292 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauugagagaagtccaccacga

SEQ ID NO: 1293 - RNA, 23 nt, Artificial Sequence
  source: /note="Description of Artificial Sequence: Synthetic oligonucleotide"
aaauugagagaaguccaccacga

SEQ ID NO: 1294 - RNA, 23 nt, Artificial Sequence
  source: /note="Description of Artificial Sequence: Synthetic oligonucleotide"
aaauugagagaaguccaccacga

SEQ ID NO: 1295 - RNA, 23 nt, Artificial Sequence
  source: /note="Description of Artificial Sequence: Synthetic oligonucleotide"
aaauugagagaaguccaccacga

SEQ ID NO: 1296 - RNA, 23 nt, Artificial Sequence
  source: /note="Description of Artificial Sequence: Synthetic oligonucleotide"
aaauugagagaaguccaccacga

SEQ ID NO: 1297 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aaauugagagaagtccaccacga

SEQ ID NO: 1298 - RNA, 23 nt, Artificial Sequence
  source: /note="Description of Artificial Sequence: Synthetic oligonucleotide"
aaauugagagaaguccaccacga

SEQ ID NO: 1299 - RNA, 23 nt, Artificial Sequence
  source: /note="Description of Artificial Sequence: Synthetic oligonucleotide"
aaauugagagaaguccaccacga

SEQ ID NO: 1300 - RNA, 23 nt, Artificial Sequence
  source: /note="Description of Artificial Sequence: Synthetic oligonucleotide"
aaauugagagaaguccaccacga

SEQ ID NO: 1301 - RNA, 23 nt, Artificial Sequence
  source: /note="Description of Artificial Sequence: Synthetic oligonucleotide"
aaauugagagaaguccaccacga

SEQ ID NO: 1302 - RNA, 21 nt, Artificial Sequence
  source: /note="Description of Artificial Sequence: Synthetic oligonucleotide"
aaauugagagaaguccaccac

SEQ ID NO: 1303 - RNA, 23 nt, Artificial Sequence
  source: /note="Description of Artificial Sequence: Synthetic oligonucleotide"
aaauugagagaaguccaccacga

SEQ ID NO: 1304 - RNA, 23 nt, Artificial Sequence
  source: /note="Description of Artificial Sequence: Synthetic oligonucleotide"
cagaggugaagcgaagugcacac

SEQ ID NO: 1305 - RNA, 23 nt, Artificial Sequence
  source: /note="Description of Artificial Sequence: Synthetic oligonucleotide"
auugugaggauuuuugucaacaa

SEQ ID NO: 1306 - RNA, 23 nt, Artificial Sequence
  source: /note="Description of Artificial Sequence: Synthetic oligonucleotide"
uugugaggauuuuugucaacaag

SEQ ID NO: 1307 - RNA, 23 nt, Artificial Sequence
  source: /note="Description of Artificial Sequence: Synthetic oligonucleotide"
uaaaauugagagaaguccaccac

SEQ ID NO: 1308 - RNA, 23 nt, Artificial Sequence
  source: /note="Description of Artificial Sequence: Synthetic oligonucleotide"
ucgaauccacacuccaaaagaca

SEQ ID NO: 1309 - RNA, 23 nt, Artificial Sequence
  source: /note="Description of Artificial Sequence: Synthetic oligonucleotide"
ucgaauccacacuccaaaagaca

SEQ ID NO: 1310 - RNA, 23 nt, Artificial Sequence
  source: /note="Description of Artificial Sequence: Synthetic oligonucleotide"
uagcuuggaggcuugaacaagac

SEQ ID NO: 1311 - RNA, 23 nt, Artificial Sequence
  source: /note="Description of Artificial Sequence: Synthetic oligonucleotide"
uccgcaguauggaucggcagagg

SEQ ID NO: 1312 - RNA, 23 nt, Artificial Sequence
  source: /note="Description of Artificial Sequence: Synthetic oligonucleotide"
uauaaaacgccgcagacacaucc

SEQ ID NO: 1313 - RNA, 23 nt, Artificial Sequence
  source: /note="Description of Artificial Sequence: Synthetic oligonucleotide"
uaugagaaggcacagacggggag

SEQ ID NO: 1314 - RNA, 23 nt, Artificial Sequence
  source: /note="Description of Artificial Sequence: Synthetic oligonucleotide"
augaacaagagaugauuagcgag

SEQ ID NO: 1315 - RNA, 23 nt, Artificial Sequence
  source: /note="Description of Artificial Sequence: Synthetic oligonucleotide"
gaaguccaccacgagucuagacu

SEQ ID NO: 1316 - RNA, 23 nt, Artificial Sequence
  source: /note="Description of Artificial Sequence: Synthetic oligonucleotide"
uuccgcaguauggaucggcagag

SEQ ID NO: 1317 - RNA, 23 nt, Artificial Sequence
  source: /note="Description of Artificial Sequence: Synthetic oligonucleotide"
uauuuuugucaacaagaaaaacc

SEQ ID NO: 1318 - RNA, 23 nt, Artificial Sequence
  source: /note="Description of Artificial Sequence: Synthetic oligonucleotide"
uagaagaaccaacaagaagauga

SEQ ID NO: 1319 - RNA, 23 nt, Artificial Sequence
  source: /note="Description of Artificial Sequence: Synthetic oligonucleotide"
auuuuugucaacaagaaaaaccc

SEQ ID NO: 1320 - RNA, 23 nt, Artificial Sequence
  source: /note="Description of Artificial Sequence: Synthetic oligonucleotide"
uaacaagagaugauuaggcagag

SEQ ID NO: 1321 - RNA, 23 nt, Artificial Sequence
  source: /note="Description of Artificial Sequence: Synthetic oligonucleotide"
uacucugugguauugugaggauu

SEQ ID NO: 1322 - RNA, 23 nt, Artificial Sequence
  source: /note="Description of Artificial Sequence: Synthetic oligonucleotide"
uugaggauuuuugucaacaagaa

SEQ ID NO: 1323 - RNA, 23 nt, Artificial Sequence
  source: /note="Description of Artificial Sequence: Synthetic oligonucleotide"
aggcagaggugaaaaaguugcau

SEQ ID NO: 1324 - RNA, 23 nt, Artificial Sequence
  source: /note="Description of Artificial Sequence: Synthetic oligonucleotide"
uaugcuguagcucuuguucccaa

SEQ ID NO: 1325 - RNA, 23 nt, Artificial Sequence
  source: /note="Description of Artificial Sequence: Synthetic oligonucleotide"
aauugagagaaguccaccagcag

SEQ ID NO: 1326 - RNA, 23 nt, Artificial Sequence
  source: /note="Description of Artificial Sequence: Synthetic oligonucleotide"
uaagaugaggcauagcagcagga

SEQ ID NO: 1327 - RNA, 23 nt, Artificial Sequence
  source: /note="Description of Artificial Sequence: Synthetic oligonucleotide"
aacgccgcagacacauccaacga

SEQ ID NO: 1328 - RNA, 23 nt, Artificial Sequence
  source: /note="Description of Artificial Sequence: Synthetic oligonucleotide"
uaggcauagcagcaggaugaaga

SEQ ID NO: 1329 - RNA, 23 nt, Artificial Sequence
  source: /note="Description of Artificial Sequence: Synthetic oligonucleotide"
uaggauuuuugucaacaagaaaa

SEQ ID NO: 1330 - RNA, 23 nt, Artificial Sequence
  source: /note="Description of Artificial Sequence: Synthetic oligonucleotide"
uaauaccacaucauccauauaac

SEQ ID NO: 1331 - RNA, 23 nt, Artificial Sequence
  source: /note="Description of Artificial Sequence: Synthetic oligonucleotide"
gaggcauagcagcaggaugaaga

SEQ ID NO: 1332 - RNA, 23 nt, Artificial Sequence
  source: /note="Description of Artificial Sequence: Synthetic oligonucleotide"
uagaggugaagcgaagugcacac

SEQ ID NO: 1333 - RNA, 23 nt, Artificial Sequence
  source: /note="Description of Artificial Sequence: Synthetic oligonucleotide"
uauugugaggauuuuugucaaca

SEQ ID NO: 1334 - RNA, 23 nt, Artificial Sequence
  source: /note="Description of Artificial Sequence: Synthetic oligonucleotide"
uaaggcacagcuuggaggcuuga

SEQ ID NO: 1335 - RNA, 23 nt, Artificial Sequence
  source: /note="Description of Artificial Sequence: Synthetic oligonucleotide"
uauagcagcaggaugaagaggaa

SEQ ID NO: 1336 - RNA, 23 nt, Artificial Sequence
  source: /note="Description of Artificial Sequence: Synthetic oligonucleotide"
aagaugaggcauagcagcaggau

SEQ ID NO: 1337 - RNA, 23 nt, Artificial Sequence
  source: /note="Description of Artificial Sequence: Synthetic oligonucleotide"
agaagaaccaacaagaagaugag

SEQ ID NO: 1338 - RNA, 23 nt, Artificial Sequence
  source: /note="Description of Artificial Sequence: Synthetic oligonucleotide"
uagaugagaaggcacagacgggg

SEQ ID NO: 1339 - RNA, 23 nt, Artificial Sequence
  source: /note="Description of Artificial Sequence: Synthetic oligonucleotide"
agaaccaacaagaagaugaggca

SEQ ID NO: 1340 - RNA, 23 nt, Artificial Sequence
  source: /note="Description of Artificial Sequence: Synthetic oligonucleotide"
uaagauaggggcauuuggugguc

SEQ ID NO: 1341 - RNA, 23 nt, Artificial Sequence
  source: /note="Description of Artificial Sequence: Synthetic oligonucleotide"
aguauggaucggcagaggagcca

SEQ ID NO: 1342 - RNA, 23 nt, Artificial Sequence
  source: /note="Description of Artificial Sequence: Synthetic oligonucleotide"
auugugaggauuuuugucaacaa

SEQ ID NO: 1343 - RNA, 23 nt, Artificial Sequence
  source: /note="Description of Artificial Sequence: Synthetic oligonucleotide"
uugugaggauuuuugucaacaag

SEQ ID NO: 1344 - RNA, 23 nt, Artificial Sequence
  source: /note="Description of Artificial Sequence: Synthetic oligonucleotide"
uaaaauugagagaaguccaccac

SEQ ID NO: 1345 - RNA, 23 nt, Artificial Sequence
  source: /note="Description of Artificial Sequence: Synthetic oligonucleotide"
ucgaauccacacuccaaaagaca

SEQ ID NO: 1346 - RNA, 23 nt, Artificial Sequence
  source: /note="Description of Artificial Sequence: Synthetic oligonucleotide"
ucgaauccacacuccaaaagaca

SEQ ID NO: 1347 - RNA, 23 nt, Artificial Sequence
  source: /note="Description of Artificial Sequence: Synthetic oligonucleotide"
uagcuuggaggcuugaacaagac

SEQ ID NO: 1348 - RNA, 23 nt, Artificial Sequence
  source: /note="Description of Artificial Sequence: Synthetic oligonucleotide"
uccgcaguauggaucggcagagg

SEQ ID NO: 1349 - RNA, 23 nt, Artificial Sequence
  source: /note="Description of Artificial Sequence: Synthetic oligonucleotide"
uaccacaucauccauauaacuga

SEQ ID NO: 1350 - RNA, 23 nt, Artificial Sequence
  source: /note="Description of Artificial Sequence: Synthetic oligonucleotide"
uauaaaacgccgcagacacaucc

SEQ ID NO: 1351 - RNA, 23 nt, Artificial Sequence
  source: /note="Description of Artificial Sequence: Synthetic oligonucleotide"
uaugagaaggcacagacggggag

SEQ ID NO: 1352 - RNA, 23 nt, Artificial Sequence
  source: /note="Description of Artificial Sequence: Synthetic oligonucleotide"
augaacaagagaugauuagcgag

SEQ ID NO: 1353 - RNA, 23 nt, Artificial Sequence
  source: /note="Description of Artificial Sequence: Synthetic oligonucleotide"
gaaguccaccacgagucuagacu

SEQ ID NO: 1354 - RNA, 23 nt, Artificial Sequence
  source: /note="Description of Artificial Sequence: Synthetic oligonucleotide"
uuccgcaguauggaucggcagag

SEQ ID NO: 1355 - RNA, 23 nt, Artificial Sequence
  source: /note="Description of Artificial Sequence: Synthetic oligonucleotide"
uagaagaaccaacaagaagauga

SEQ ID NO: 1356 - RNA, 23 nt, Artificial Sequence
  source: /note="Description of Artificial Sequence: Synthetic oligonucleotide"
uccccuagaaaauugagagaagu

SEQ ID NO: 1357 - RNA, 23 nt, Artificial Sequence
  source: /note="Description of Artificial Sequence: Synthetic oligonucleotide"
ugagagaaguccaccacgagucu

SEQ ID NO: 1358 - RNA, 23 nt, Artificial Sequence
  source: /note="Description of Artificial Sequence: Synthetic oligonucleotide"
cagaggugaagcgaagugcacac

SEQ ID NO: 1359 - RNA, 23 nt, Artificial Sequence
  source: /note="Description of Artificial Sequence: Synthetic oligonucleotide"
auuuuugucaacaagaaaaaccc

SEQ ID NO: 1360 - RNA, 23 nt, Artificial Sequence
  source: /note="Description of Artificial Sequence: Synthetic oligonucleotide"
uaacaagagaugauuaggcagag

SEQ ID NO: 1361 - RNA, 23 nt, Artificial Sequence
  source: /note="Description of Artificial Sequence: Synthetic oligonucleotide"
uacucugugguauugugaggauu

SEQ ID NO: 1362 - RNA, 23 nt, Artificial Sequence
  source: /note="Description of Artificial Sequence: Synthetic oligonucleotide"
uugaggauuuuugucaacaagaa

SEQ ID NO: 1363 - RNA, 23 nt, Artificial Sequence
  source: /note="Description of Artificial Sequence: Synthetic oligonucleotide"
aaauugagagaaguccaccacga

SEQ ID NO: 1364 - RNA, 23 nt, Artificial Sequence
  source: /note="Description of Artificial Sequence: Synthetic oligonucleotide"
aggcagaggugaaaaaguugcau

SEQ ID NO: 1365 - RNA, 23 nt, Artificial Sequence
  source: /note="Description of Artificial Sequence: Synthetic oligonucleotide"
uaugcuguagcucuuguucccaa

SEQ ID NO: 1366 - RNA, 23 nt, Artificial Sequence
  source: /note="Description of Artificial Sequence: Synthetic oligonucleotide"
uaagaaccaacaagaagaugagg

SEQ ID NO: 1367 - RNA, 23 nt, Artificial Sequence
  source: /note="Description of Artificial Sequence: Synthetic oligonucleotide"
uaagaugaggcauagcagcagga

SEQ ID NO: 1368 - RNA, 23 nt, Artificial Sequence
  source: /note="Description of Artificial Sequence: Synthetic oligonucleotide"
aacgccgcagacacauccaacga

SEQ ID NO: 1369 - RNA, 23 nt, Artificial Sequence
  source: /note="Description of Artificial Sequence: Synthetic oligonucleotide"
uaggcauagcagcaggaugaaga

SEQ ID NO: 1370 - RNA, 23 nt, Artificial Sequence
  source: /note="Description of Artificial Sequence: Synthetic oligonucleotide"
uaggauuuuugucaacaagaaaa

SEQ ID NO: 1371 - RNA, 23 nt, Artificial Sequence
  source: /note="Description of Artificial Sequence: Synthetic oligonucleotide"
uaaaacgccgcagacacauccag

SEQ ID NO: 1372 - RNA, 23 nt, Artificial Sequence
  source: /note="Description of Artificial Sequence: Synthetic oligonucleotide"
uaauaccacaucauccauauaac

SEQ ID NO: 1373 - RNA, 23 nt, Artificial Sequence
  source: /note="Description of Artificial Sequence: Synthetic oligonucleotide"
gaggcauagcagcaggaugaaga

SEQ ID NO: 1374 - RNA, 23 nt, Artificial Sequence
  source: /note="Description of Artificial Sequence: Synthetic oligonucleotide"
uagaggugaagcgaagugcacac

SEQ ID NO: 1375 - RNA, 23 nt, Artificial Sequence
  source: /note="Description of Artificial Sequence: Synthetic oligonucleotide"
uauugugaggauuuuugucaaca

SEQ ID NO: 1376 - RNA, 23 nt, Artificial Sequence
  source: /note="Description of Artificial Sequence: Synthetic oligonucleotide"
uuugcgucagcaaacacuuggca

SEQ ID NO: 1377 - RNA, 23 nt, Artificial Sequence
  source: /note="Description of Artificial Sequence: Synthetic oligonucleotide"
uuugcgucagcaaacacuuggca

SEQ ID NO: 1378 - RNA, 23 nt, Artificial Sequence
  source: /note="Description of Artificial Sequence: Synthetic oligonucleotide"
uaaggcacagcuuggaggcuuga

SEQ ID NO: 1379 - RNA, 23 nt, Artificial Sequence
  source: /note="Description of Artificial Sequence: Synthetic oligonucleotide"
uauagcagcaggaugaagaggaa

SEQ ID NO: 1380 - RNA, 23 nt, Artificial Sequence
  source: /note="Description of Artificial Sequence: Synthetic oligonucleotide"
aagaugaggcauagcagcaggau

SEQ ID NO: 1381 - RNA, 23 nt, Artificial Sequence
  source: /note="Description of Artificial Sequence: Synthetic oligonucleotide"
agaagaaccaacaagaagaugag

SEQ ID NO: 1382 - RNA, 23 nt, Artificial Sequence
  source: /note="Description of Artificial Sequence: Synthetic oligonucleotide"
uagaugagaaggcacagacgggg

SEQ ID NO: 1383 - RNA, 23 nt, Artificial Sequence
  source: /note="Description of Artificial Sequence: Synthetic oligonucleotide"
agaaccaacaagaagaugaggca

SEQ ID NO: 1384 - RNA, 23 nt, Artificial Sequence
  source: /note="Description of Artificial Sequence: Synthetic oligonucleotide"
uaagauaggggcauuuggugguc

SEQ ID NO: 1385 - RNA, 23 nt, Artificial Sequence
  source: /note="Description of Artificial Sequence: Synthetic oligonucleotide"
aguauggaucggcagaggagcca

SEQ ID NO: 1386 - RNA, 23 nt, Artificial Sequence
  source: /note="Description of Artificial Sequence: Synthetic oligonucleotide"
ugagagaaguccaccacgagucu

SEQ ID NO: 1387 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1388 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaaguccaccacgagucu

SEQ ID NO: 1389 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1390 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaaguccaccacgagucu

SEQ ID NO: 1391 - RNA, 23 nt, Artificial Sequence
  source: /note="Description of Artificial Sequence: Synthetic oligonucleotide"
ugagagaaguccaccacgagucu

SEQ ID NO: 1392 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaaguccaccacgagucu

SEQ ID NO: 1393 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1394 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1395 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1396 - RNA, 23 nt, Artificial Sequence
  source: /note="Description of Artificial Sequence: Synthetic oligonucleotide"
ugagagaaguccaccacgagucu

SEQ ID NO: 1397 - RNA, 23 nt, Artificial Sequence
  source: /note="Description of Artificial Sequence: Synthetic oligonucleotide"
ugagagaaguccaccacgagucu

SEQ ID NO: 1398 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaaguccaccacgagucu

SEQ ID NO: 1399 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1400 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1401 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1402 - RNA, 23 nt, Artificial Sequence
  source: /note="Description of Artificial Sequence: Synthetic oligonucleotide"
ugagagaaguccaccacgagucu

SEQ ID NO: 1403 - RNA, 23 nt, Artificial Sequence
  source: /note="Description of Artificial Sequence: Synthetic oligonucleotide"
ugagagaaguccaccacgagucu

SEQ ID NO: 1404 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaaguccaccacgagucu

SEQ ID NO: 1405 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1406 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1407 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1408 - RNA, 23 nt, Artificial Sequence
  source: /note="Description of Artificial Sequence: Synthetic oligonucleotide"
ugagagaaguccaccacgagucu

SEQ ID NO: 1409 - RNA, 23 nt, Artificial Sequence
  source: /note="Description of Artificial Sequence: Synthetic oligonucleotide"
ugagagaaguccaccacgagucu

SEQ ID NO: 1410 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1411 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaaguccaccacgagucu

SEQ ID NO: 1412 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1413 - RNA, 23 nt, Artificial Sequence
  source: /note="Description of Artificial Sequence: Synthetic oligonucleotide"
ugagagaaguccaccacgagucu

SEQ ID NO: 1414 - RNA, 23 nt, Artificial Sequence
  source: /note="Description of Artificial Sequence: Synthetic oligonucleotide"
ugagagaaguccaccacgagucu

SEQ ID NO: 1415 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1416 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1417 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaaguccaccacgagucu

SEQ ID NO: 1418 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1419 - RNA, 23 nt, Artificial Sequence
  source: /note="Description of Artificial Sequence: Synthetic oligonucleotide"
ugagagaaguccaccacgagucu

SEQ ID NO: 1420 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1421 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1422 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1423 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaaguccaccacgagucu

SEQ ID NO: 1424 - RNA, 23 nt, Artificial Sequence
  source: /note="Description of Artificial Sequence: Synthetic oligonucleotide"
ugagagaaguccaccacgagucu

SEQ ID NO: 1425 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1426 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1427 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaagtccaccacgagucu

SEQ ID NO: 1428 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
ugagagaaguccaccacgagucu

SEQ ID NO: 1429 - RNA, 19 nt, Artificial Sequence
  source: /note="Description of Artificial Sequence: Synthetic oligonucleotide"
ucgugguggacuucucuca

SEQ ID NO: 1430 - RNA, 19 nt, Artificial Sequence
  source: /note="Description of Artificial Sequence: Synthetic oligonucleotide"
ucgugguggacuucucuca

SEQ ID NO: 1431 - RNA, 21 nt, Artificial Sequence
  source: /note="Description of Artificial Sequence: Synthetic oligonucleotide"
  modified_base (1)..(1): 2-hydroxymethyl-tetrahydrofurane-5-phosphate
  modified_base (21)..(21): 2-hydroxymethyl-tetrahydrofurane-5-phosphate
nucgugguggacuucucucan

SEQ ID NO: 1432 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nacucgugguggacuucucuca

SEQ ID NO: 1433 - RNA, 19 nt, Artificial Sequence
  source: /note="Description of Artificial Sequence: Synthetic oligonucleotide"
ucgugguggacuucucuca

SEQ ID NO: 1434 - RNA, 19 nt, Artificial Sequence
  source: /note="Description of Artificial Sequence: Synthetic oligonucleotide"
ucgugguggacuucucuca

SEQ ID NO: 1435 - RNA, 23 nt, Artificial Sequence
  source: /note="Description of Artificial Sequence: Synthetic oligonucleotide"
  modified_base (1)..(1): 2-hydroxymethyl-tetrahydrofurane-5-phosphate
  modified_base (23)..(23): 2-hydroxymethyl-tetrahydrofurane-5-phosphate
nucgugguggacuucucucauun

SEQ ID NO: 1436 - RNA, 21 nt, Artificial Sequence
  source: /note="Description of Artificial Sequence: Synthetic oligonucleotide"
acucgugguggacuucucuca

SEQ ID NO: 1437 - RNA, 19 nt, Artificial Sequence
  source: /note="Description of Artificial Sequence: Synthetic oligonucleotide"
ucgugguggacuucucuca

SEQ ID NO: 1438 - RNA, 21 nt, Artificial Sequence
  source: /note="Description of Artificial Sequence: Synthetic oligonucleotide"
acucgugguggacuucucuca

SEQ ID NO: 1439 - RNA, 21 nt, Artificial Sequence
  source: /note="Description of Artificial Sequence: Synthetic oligonucleotide"
gugcacuucgcuucaccucua

SEQ ID NO: 1440 - RNA, 21 nt, Artificial Sequence
  source: /note="Description of Artificial Sequence: Synthetic oligonucleotide"
gugcacuucgcuucaccucua

SEQ ID NO: 1441 - RNA, 19 nt, Artificial Sequence
  source: /note="Description of Artificial Sequence: Synthetic oligonucleotide"
gcacuucgcuucaccucua

SEQ ID NO: 1442 - RNA, 21 nt, Artificial Sequence
  source: /note="Description of Artificial Sequence: Synthetic oligonucleotide"
gugcacuucgcuucaccucug

SEQ ID NO: 1443 - RNA, 21 nt, Artificial Sequence
  source: /note="Description of Artificial Sequence: Synthetic oligonucleotide"
augugucugcggcguuuuaua

SEQ ID NO: 1444 - RNA, 21 nt, Artificial Sequence
  source: /note="Description of Artificial Sequence: Synthetic oligonucleotide"
gugcacuucgcuucaccucug

SEQ ID NO: 1445 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
gcacuucgcuucaccucua

SEQ ID NO: 1446 - RNA, 19 nt, Artificial Sequence
  source: /note="Description of Artificial Sequence: Synthetic oligonucleotide"
gguggacuucucucaauuu

SEQ ID NO: 1447 - RNA, 21 nt, Artificial Sequence
  source: /note="Description of Artificial Sequence: Synthetic oligonucleotide"
cgugguggacuucucucaauu

SEQ ID NO: 1448 - RNA, 21 nt, Artificial Sequence
  source: /note="Description of Artificial Sequence: Synthetic oligonucleotide"
gugguggacuucucucaauuu

SEQ ID NO: 1449 - RNA, 21 nt, Artificial Sequence
  source: /note="Description of Artificial Sequence: Synthetic oligonucleotide"
cgugguggacuucucucaauu

SEQ ID NO: 1450 - RNA, 19 nt, Artificial Sequence
  source: /note="Description of Artificial Sequence: Synthetic oligonucleotide"
gguggacuucucucaauuu

SEQ ID NO: 1451 - RNA, 21 nt, Artificial Sequence
  source: /note="Description of Artificial Sequence: Synthetic oligonucleotide"
gugguggacuucucucaauuu

SEQ ID NO: 1452 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
uggugguctucucuaaauu

SEQ ID NO: 1453 - RNA, 21 nt, Artificial Sequence
  source: /note="Description of Artificial Sequence: Synthetic oligonucleotide"
gugguggacuucucucaauuu

SEQ ID NO: 1454 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguggugguctucucuaaauu

SEQ ID NO: 1455 - RNA, 21 nt, Artificial Sequence
  source: /note="Description of Artificial Sequence: Synthetic oligonucleotide"
gguggacuucucucaauuuua

SEQ ID NO: 1456 - RNA, 21 nt, Artificial Sequence
  source: /note="Description of Artificial Sequence: Synthetic oligonucleotide"
gguggacuucucucaauuuua

SEQ ID NO: 1457 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
uggacuactcucaaauuua

SEQ ID NO: 1458 - RNA, 21 nt, Artificial Sequence
  source: /note="Description of Artificial Sequence: Synthetic oligonucleotide"
ugagagaaguccaccacgauu

SEQ ID NO: 1459 - RNA, 21 nt, Artificial Sequence
  source: /note="Description of Artificial Sequence: Synthetic oligonucleotide"
ugagagaaguccaccacgauu

SEQ ID NO: 1460 - RNA, 21 nt, Artificial Sequence
  source: /note="Description of Artificial Sequence: Synthetic oligonucleotide"
ugagagaaguccaccacgauu

SEQ ID NO: 1461 - RNA, 23 nt, Artificial Sequence
  source: /note="Description of Artificial Sequence: Synthetic oligonucleotide"
ugagagaaguccaccacgagucu

SEQ ID NO: 1462 - RNA, 21 nt, Artificial Sequence
  source: /note="Description of Artificial Sequence: Synthetic oligonucleotide"
ugagagaaguccaccacgauu

SEQ ID NO: 1463 - RNA, 21 nt, Artificial Sequence
  source: /note="Description of Artificial Sequence: Synthetic oligonucleotide"
ugagagaaguccaccacgauu

SEQ ID NO: 1464 - RNA, 21 nt, Artificial Sequence
  source: /note="Description of Artificial Sequence: Synthetic oligonucleotide"
ugagagaaguccaccacgauu

SEQ ID NO: 1465 - RNA, 23 nt, Artificial Sequence
  source: /note="Description of Artificial Sequence: Synthetic oligonucleotide"
ugagagaaguccaccacgagucu

SEQ ID NO: 1466 - RNA, 21 nt, Artificial Sequence
  source: /note="Description of Artificial Sequence: Synthetic oligonucleotide"
ugagagaaguccaccacgauu

SEQ ID NO: 1467 - RNA, 23 nt, Artificial Sequence
  source: /note="Description of Artificial Sequence: Synthetic oligonucleotide"
ugagagaaguccaccacgaguuu

SEQ ID NO: 1468 - RNA, 23 nt, Artificial Sequence
  source: /note="Description of Artificial Sequence: Synthetic oligonucleotide"
uagaggugaagcgaagugcacuu

SEQ ID NO: 1469 - RNA, 23 nt, Artificial Sequence
  source: /note="Description of Artificial Sequence: Synthetic oligonucleotide"
uagaggugaagcgaagugcacac

SEQ ID NO: 1470 - RNA, 21 nt, Artificial Sequence
  source: /note="Description of Artificial Sequence: Synthetic oligonucleotide"
uagaggugaagcgaagugcac

SEQ ID NO: 1471 - RNA, 23 nt, Artificial Sequence
  source: /note="Description of Artificial Sequence: Synthetic oligonucleotide"
cagaggugaagcgaagugcacac

SEQ ID NO: 1472 - RNA, 23 nt, Artificial Sequence
  source: /note="Description of Artificial Sequence: Synthetic oligonucleotide"
uauaaaacgccgcagacacaucc

SEQ ID NO: 1473 - RNA, 23 nt, Artificial Sequence
  source: /note="Description of Artificial Sequence: Synthetic oligonucleotide"
cagaggugaagcgaagugcacac

SEQ ID NO: 1474 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uagaggugaagcgaagugcuu

SEQ ID NO: 1475 - RNA, 21 nt, Artificial Sequence
  source: /note="Description of Artificial Sequence: Synthetic oligonucleotide"
aaauugagagaaguccaccac

SEQ ID NO: 1476 - RNA, 23 nt, Artificial Sequence
  source: /note="Description of Artificial Sequence: Synthetic oligonucleotide"
aauugagagaaguccaccagcag

SEQ ID NO: 1477 - RNA, 23 nt, Artificial Sequence
  source: /note="Description of Artificial Sequence: Synthetic oligonucleotide"
aaauugagagaaguccaccacga

SEQ ID NO: 1478 - RNA, 23 nt, Artificial Sequence
  source: /note="Description of Artificial Sequence: Synthetic oligonucleotide"
aauugagagaaguccaccagcag

SEQ ID NO: 1479 - RNA, 21 nt, Artificial Sequence
  source: /note="Description of Artificial Sequence: Synthetic oligonucleotide"
aaauugagagaaguccaccac

SEQ ID NO: 1480 - RNA, 23 nt, Artificial Sequence
  source: /note="Description of Artificial Sequence: Synthetic oligonucleotide"
aaauugagagaaguccaccacga

SEQ ID NO: 1481 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aauugagagaaguccaccauu

SEQ ID NO: 1482 - RNA, 23 nt, Artificial Sequence
  source: /note="Description of Artificial Sequence: Synthetic oligonucleotide"
aaauugagagaaguccaccacga

SEQ ID NO: 1483 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauugagagaaguccaccagcuu

SEQ ID NO: 1484 - RNA, 23 nt, Artificial Sequence
  source: /note="Description of Artificial Sequence: Synthetic oligonucleotide"
uaaaauugagagaaguccaccac

SEQ ID NO: 1485 - RNA, 23 nt, Artificial Sequence
  source: /note="Description of Artificial Sequence: Synthetic oligonucleotide"
uaaaauugagagaaguccaccac

SEQ ID NO: 1486 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaaaauugagagaaguccauu

SEQ ID NO: 1487 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgaaggaaggcccucgagtt

SEQ ID NO: 1488 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cgaaggaaggcccucgagatt

SEQ ID NO: 1489 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaggaaggcccucgagaatt

SEQ ID NO: 1490 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aggaaggcccucgagaacatt

SEQ ID NO: 1491 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaaggcccucgagaacaatt

SEQ ID NO: 1492 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaaggcccucgagaacaagtt

SEQ ID NO: 1493 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggugugaacccccucgatt

SEQ ID NO: 1494 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggugugaacccccucgaatt

SEQ ID NO: 1495 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggugugaacccccucgaagtt

SEQ ID NO: 1496 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugugaacccccucgaaggutt

SEQ ID NO: 1497 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaaaucccuggcuggggaatt

SEQ ID NO: 1498 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaucccuggcuggggaacatt

SEQ ID NO: 1499 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aucccuggcuggggaacautt

SEQ ID NO: 1500 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aagagcggguucaccgacatt

SEQ ID NO: 1501 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agagcggguucaccgacaatt

SEQ ID NO: 1502 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gagcggguucaccgacaagtt

SEQ ID NO: 1503 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gcggguucaccgacaaggatt

SEQ ID NO: 1504 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cggguucaccgacaaggagtt

SEQ ID NO: 1505 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggguucaccgacaaggagatt

SEQ ID NO: 1506 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gguucaccgacaaggagagtt

SEQ ID NO: 1507 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggagggacuggacaucagtt

SEQ ID NO: 1508 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggguagaggaaaggaagaatt

SEQ ID NO: 1509 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaggcgggaccacagaagatt

SEQ ID NO: 1510 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acagaagaaggaaggcccutt

SEQ ID NO: 1511 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaagaagaggaacuccggatt

SEQ ID NO: 1512 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cagggaugacgacgaaagatt

SEQ ID NO: 1513 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggaugacgacgaaagagatt

SEQ ID NO: 1514 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaugacgacgaaagagaatt

SEQ ID NO: 1515 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccugggggugugaacccaatt

SEQ ID NO: 1516 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugggggugugaacccaautt

SEQ ID NO: 1517 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ccuuuucccgaacgggagatt

SEQ ID NO: 1518 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gaacgggagaggggaucgatt

SEQ ID NO: 1519 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acgggagaggggaucgacatt

SEQ ID NO: 1520 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agaggggaucgacauccgatt

SEQ ID NO: 1521 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggggaucgacauccgaggatt

SEQ ID NO: 1522 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
gggaucgacauccgaggaatt

SEQ ID NO: 1523 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
acauccgaggaacccagcatt

SEQ ID NO: 1524 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ggaacccagcaguucccautt

SEQ ID NO: 1525 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucgagggccuuccuucgutt

SEQ ID NO: 1526 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucgagggccuuccuucgtt

SEQ ID NO: 1527 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucgagggccuuccuuctt

SEQ ID NO: 1528 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguucucgagggccuuccutt

SEQ ID NO: 1529 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuguucucgagggccuucctt

SEQ ID NO: 1530 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuguucucgagggccuuctt

SEQ ID NO: 1531 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaggggguucacacccctt

SEQ ID NO: 1532 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgaggggguucacaccctt

SEQ ID NO: 1533 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuucgaggggguucacacctt

SEQ ID NO: 1534 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
accuucgaggggguucacatt

SEQ ID NO: 1535 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccccagccagggauuuutt

SEQ ID NO: 1536 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uguuccccagccagggauutt

SEQ ID NO: 1537 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auguuccccagccagggautt

SEQ ID NO: 1538 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucggugaacccgcucuutt

SEQ ID NO: 1539 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uugucggugaacccgcucutt

SEQ ID NO: 1540 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuugucggugaacccgcuctt

SEQ ID NO: 1541 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccuugucggugaacccgctt

SEQ ID NO: 1542 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuccuugucggugaacccgtt

SEQ ID NO: 1543 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuccuugucggugaaccctt

SEQ ID NO: 1544 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cucuccuugucggugaacctt

SEQ ID NO: 1545 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cugauguccagucccuccctt

SEQ ID NO: 1546 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucuuccuuuccucuaccctt

SEQ ID NO: 1547 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuucuguggucccgccuctt

SEQ ID NO: 1548 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
agggccuuccuucuucugutt

SEQ ID NO: 1549 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccggaguuccucuucuuctt

SEQ ID NO: 1550 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuucgucgucaucccugtt

SEQ ID NO: 1551 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucuuucgucgucauccctt

SEQ ID NO: 1552 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucucuuucgucgucaucctt

SEQ ID NO: 1553 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuggguucacacccccaggtt

SEQ ID NO: 1554 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
auuggguucacacccccagtt

SEQ ID NO: 1555 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucccguucgggaaaaggtt

SEQ ID NO: 1556 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgauccccucucccguuctt

SEQ ID NO: 1557 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugucgauccccucucccgutt

SEQ ID NO: 1558 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucggaugucgauccccucutt

SEQ ID NO: 1559 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccucggaugucgaucccctt

SEQ ID NO: 1560 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuccucggaugucgauccctt

SEQ ID NO: 1561 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugcuggguuccucggaugutt

SEQ ID NO: 1562 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
augggaacugcuggguucctt

SEQ ID NO: 1563 - RNA, 19 nt, Artificial Sequence
  source: /note="Description of Artificial Sequence: Synthetic oligonucleotide"
ucgugguggacuucucuca

SEQ ID NO: 1564 - RNA, 19 nt, Artificial Sequence
  source: /note="Description of Artificial Sequence: Synthetic oligonucleotide"
ucgugguggacuucucuca

SEQ ID NO: 1565 - RNA, 19 nt, Artificial Sequence
  source: /note="Description of Artificial Sequence: Synthetic oligonucleotide"
ucgugguggacuucucuca

SEQ ID NO: 1566 - RNA, 21 nt, Artificial Sequence
  source: /note="Description of Artificial Sequence: Synthetic oligonucleotide"
gugcacuucgcuucaccucua

SEQ ID NO: 1567 - RNA, 21 nt, Artificial Sequence
  source: /note="Description of Artificial Sequence: Synthetic oligonucleotide"
gugcacuucgcuucaccucua

SEQ ID NO: 1568 - RNA, 21 nt, Artificial Sequence
  source: /note="Description of Artificial Sequence: Synthetic oligonucleotide"
gugcacuucgcuucaccucua

SEQ ID NO: 1569 - RNA, 21 nt, Artificial Sequence
  source: /note="Description of Artificial Sequence: Synthetic oligonucleotide"
cgugguggacuucucucaauu

SEQ ID NO: 1570 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguggugguctucucuaaauu

SEQ ID NO: 1571 - RNA, 21 nt, Artificial Sequence
  source: /note="Description of Artificial Sequence: Synthetic oligonucleotide"
gguggacuucucucaauuuua

SEQ ID NO: 1572 - RNA, 21 nt, Artificial Sequence
  source: /note="Description of Artificial Sequence: Synthetic oligonucleotide"
gguggacuucucucaauuuua

SEQ ID NO: 1573 - RNA, 21 nt, Artificial Sequence
  source: /note="Description of Artificial Sequence: Synthetic oligonucleotide"
gguggacuucucucaauuuua

SEQ ID NO: 1574 - RNA, 21 nt, Artificial Sequence
  source: /note="Description of Artificial Sequence: Synthetic oligonucleotide"
ugagagaaguccaccacgauu

SEQ ID NO: 1575 - RNA, 21 nt, Artificial Sequence
  source: /note="Description of Artificial Sequence: Synthetic oligonucleotide"
ugagagaaguccaccacgauu

SEQ ID NO: 1576 - RNA, 21 nt, Artificial Sequence
  source: /note="Description of Artificial Sequence: Synthetic oligonucleotide"
ugagagaaguccaccacgauu

SEQ ID NO: 1577 - RNA, 23 nt, Artificial Sequence
  source: /note="Description of Artificial Sequence: Synthetic oligonucleotide"
uagaggugaagcgaagugcacuu

SEQ ID NO: 1578 - RNA, 23 nt, Artificial Sequence
  source: /note="Description of Artificial Sequence: Synthetic oligonucleotide"
uagaggugaagcgaagugcacuu

SEQ ID NO: 1579 - RNA, 23 nt, Artificial Sequence
  source: /note="Description of Artificial Sequence: Synthetic oligonucleotide"
uagaggugaagcgaagugcacuu

SEQ ID NO: 1580 - RNA, 23 nt, Artificial Sequence
  source: /note="Description of Artificial Sequence: Synthetic oligonucleotide"
aauugagagaaguccaccagcag

SEQ ID NO: 1581 - RNA, 23 nt, Artificial Sequence
  source: /note="Description of Artificial Sequence: Synthetic oligonucleotide"
aauugagagaaguccaccagcuu

SEQ ID NO: 1582 - RNA, 23 nt, Artificial Sequence
  source: /note="Description of Artificial Sequence: Synthetic oligonucleotide"
uaaaauugagagaaguccaccac

SEQ ID NO: 1583 - RNA, 23 nt, Artificial Sequence
  source: /note="Description of Artificial Sequence: Synthetic oligonucleotide"
uaaaauugagagaaguccaccac

SEQ ID NO: 1584 - RNA, 23 nt, Artificial Sequence
  source: /note="Description of Artificial Sequence: Synthetic oligonucleotide"
uaaaauugagagaaguccaccac

SEQ ID NO: 1585 - RNA, 19 nt, Artificial Sequence
  source: /note="Description of Artificial Sequence: Synthetic oligonucleotide"
ucgugguggacuucucuca

SEQ ID NO: 1586 - RNA, 19 nt, Artificial Sequence
  source: /note="Description of Artificial Sequence: Synthetic oligonucleotide"
ucgugguggacuucucuca

SEQ ID NO: 1587 - RNA, 19 nt, Artificial Sequence
  source: /note="Description of Artificial Sequence: Synthetic oligonucleotide"
ucgugguggacuucucuca

SEQ ID NO: 1588 - RNA, 21 nt, Artificial Sequence
  source: /note="Description of Artificial Sequence: Synthetic oligonucleotide"
gugcacuucgcuucaccucua

SEQ ID NO: 1589 - RNA, 21 nt, Artificial Sequence
  source: /note="Description of Artificial Sequence: Synthetic oligonucleotide"
gugcacuucgcuucaccucua

SEQ ID NO: 1590 - RNA, 21 nt, Artificial Sequence
  source: /note="Description of Artificial Sequence: Synthetic oligonucleotide"
gugcacuucgcuucaccucua

SEQ ID NO: 1591 - RNA, 21 nt, Artificial Sequence
  source: /note="Description of Artificial Sequence: Synthetic oligonucleotide"
cgugguggacuucucucaauu

SEQ ID NO: 1592 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cguggugguctucucuaaauu

SEQ ID NO: 1593 - RNA, 21 nt, Artificial Sequence
  source: /note="Description of Artificial Sequence: Synthetic oligonucleotide"
gguggacuucucucaauuuua

SEQ ID NO: 1594 - RNA, 21 nt, Artificial Sequence
  source: /note="Description of Artificial Sequence: Synthetic oligonucleotide"
gguggacuucucucaauuuua

SEQ ID NO: 1595 - RNA, 21 nt, Artificial Sequence
  source: /note="Description of Artificial Sequence: Synthetic oligonucleotide"
gguggacuucucucaauuuua

SEQ ID NO: 1596 - RNA, 21 nt, Artificial Sequence
  source: /note="Description of Artificial Sequence: Synthetic oligonucleotide"
ugagagaaguccaccacgauu

SEQ ID NO: 1597 - RNA, 21 nt, Artificial Sequence
  source: /note="Description of Artificial Sequence: Synthetic oligonucleotide"
ugagagaaguccaccacgauu

SEQ ID NO: 1598 - RNA, 21 nt, Artificial Sequence
  source: /note="Description of Artificial Sequence: Synthetic oligonucleotide"
ugagagaaguccaccacgauu

SEQ ID NO: 1599 - RNA, 23 nt, Artificial Sequence
  source: /note="Description of Artificial Sequence: Synthetic oligonucleotide"
uagaggugaagcgaagugcacuu

SEQ ID NO: 1600 - RNA, 23 nt, Artificial Sequence
  source: /note="Description of Artificial Sequence: Synthetic oligonucleotide"
uagaggugaagcgaagugcacuu

SEQ ID NO: 1601 - RNA, 23 nt, Artificial Sequence
  source: /note="Description of Artificial Sequence: Synthetic oligonucleotide"
uagaggugaagcgaagugcacuu

SEQ ID NO: 1602 - RNA, 23 nt, Artificial Sequence
  source: /note="Description of Artificial Sequence: Synthetic oligonucleotide"
aauugagagaaguccaccagcag

SEQ ID NO: 1603 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aauugagagaaguccaccagcuu

SEQ ID NO: 1604 - RNA, 23 nt, Artificial Sequence
  source: /note="Description of Artificial Sequence: Synthetic oligonucleotide"
uaaaauugagagaaguccaccac

SEQ ID NO: 1605 - RNA, 23 nt, Artificial Sequence
  source: /note="Description of Artificial Sequence: Synthetic oligonucleotide"
uaaaauugagagaaguccaccac

SEQ ID NO: 1606 - RNA, 23 nt, Artificial Sequence
  source: /note="Description of Artificial Sequence: Synthetic oligonucleotide"
uaaaauugagagaaguccaccac

SEQ ID NO: 1607 - RNA, 21 nt, Artificial Sequence
  source: /note="Description of Artificial Sequence: Synthetic oligonucleotide"
ugugcacuucgcuucaccucu

SEQ ID NO: 1608 - RNA, 21 nt, Artificial Sequence
  source: /note="Description of Artificial Sequence: Synthetic oligonucleotide"
ugcacuucgcuucaccucuga

SEQ ID NO: 1609 - RNA, 21 nt, Artificial Sequence
  source: /note="Description of Artificial Sequence: Synthetic oligonucleotide"
gugugcacuucgcuucaccua

SEQ ID NO: 1610 - RNA, 21 nt, Artificial Sequence
  source: /note="Description of Artificial Sequence: Synthetic oligonucleotide"
cgugugcacuucgcuucaccu

SEQ ID NO: 1611 - RNA, 21 nt, Artificial Sequence
  source: /note="Description of Artificial Sequence: Synthetic oligonucleotide"
gugcacuucgcuucaccucua

SEQ ID NO: 1612 - RNA, 21 nt, Artificial Sequence
  source: /note="Description of Artificial Sequence: Synthetic oligonucleotide"
ccgugugcacuucgcuucaca

SEQ ID NO: 1613 - RNA, 21 nt, Artificial Sequence
  source: /note="Description of Artificial Sequence: Synthetic oligonucleotide"
cacuucgcuucaccucugcaa

SEQ ID NO: 1614 - RNA, 21 nt, Artificial Sequence
  source: /note="Description of Artificial Sequence: Synthetic oligonucleotide"
acuucgcuucaccucugcaca

SEQ ID NO: 1615 - RNA, 21 nt, Artificial Sequence
  source: /note="Description of Artificial Sequence: Synthetic oligonucleotide"
ggcuguaggcauaaauuggua

SEQ ID NO: 1616 - RNA, 21 nt, Artificial Sequence
  source: /note="Description of Artificial Sequence: Synthetic oligonucleotide"
uucgcuucaccucugcacgua

SEQ ID NO: 1617 - RNA, 21 nt, Artificial Sequence
  source: /note="Description of Artificial Sequence: Synthetic oligonucleotide"
ucgcuucaccucugcacguca

SEQ ID NO: 1618 - RNA, 21 nt, Artificial Sequence
  source: /note="Description of Artificial Sequence: Synthetic oligonucleotide"
cuucgcuucaccucugcacgu

SEQ ID NO: 1619 - RNA, 21 nt, Artificial Sequence
  source: /note="Description of Artificial Sequence: Synthetic oligonucleotide"
ccccgucugugccuucucaua

SEQ ID NO: 1620 - RNA, 21 nt, Artificial Sequence
  source: /note="Description of Artificial Sequence: Synthetic oligonucleotide"
ccgucugugccuucucaucua

SEQ ID NO: 1621 - RNA, 21 nt, Artificial Sequence
  source: /note="Description of Artificial Sequence: Synthetic oligonucleotide"
ccagcaccaugcaacuuuuua

SEQ ID NO: 1622 - RNA, 21 nt, Artificial Sequence
  source: /note="Description of Artificial Sequence: Synthetic oligonucleotide"
caccagcaccaugcaacuuuu

SEQ ID NO: 1623 - RNA, 21 nt, Artificial Sequence
  source: /note="Description of Artificial Sequence: Synthetic oligonucleotide"
caccaugcaacuuuuucaccu

SEQ ID NO: 1624 - RNA, 21 nt, Artificial Sequence
  source: /note="Description of Artificial Sequence: Synthetic oligonucleotide"
caaugucaacgaccgaccuua

SEQ ID NO: 1625 - RNA, 21 nt, Artificial Sequence
  source: /note="Description of Artificial Sequence: Synthetic oligonucleotide"
cgcuucaccucugcacgucga

SEQ ID NO: 1626 - RNA, 21 nt, Artificial Sequence
  source: /note="Description of Artificial Sequence: Synthetic oligonucleotide"
accuugaggcauacuucaaag

SEQ ID NO: 1627 - RNA, 21 nt, Artificial Sequence
  source: /note="Description of Artificial Sequence: Synthetic oligonucleotide"
ccgaccuugaggcauacuuca

SEQ ID NO: 1628 - RNA, 21 nt, Artificial Sequence
  source: /note="Description of Artificial Sequence: Synthetic oligonucleotide"
gaccuugaggcauacuucaaa

SEQ ID NO: 1629 - RNA, 21 nt, Artificial Sequence
  source: /note="Description of Artificial Sequence: Synthetic oligonucleotide"
accgaccuugaggcauacuua

SEQ ID NO: 1630 - RNA, 21 nt, Artificial Sequence
  source: /note="Description of Artificial Sequence: Synthetic oligonucleotide"
ucgcauggagaccaccgugaa

SEQ ID NO: 1631 - RNA, 21 nt, Artificial Sequence
  source: /note="Description of Artificial Sequence: Synthetic oligonucleotide"
uuacauaagaggacucuugga

SEQ ID NO: 1632 - RNA, 21 nt, Artificial Sequence
  source: /note="Description of Artificial Sequence: Synthetic oligonucleotide"
ucuuacauaagaggacucuua

SEQ ID NO: 1633 - RNA, 21 nt, Artificial Sequence
  source: /note="Description of Artificial Sequence: Synthetic oligonucleotide"
acuucaaagacuguuuguuua

SEQ ID NO: 1634 - RNA, 21 nt, Artificial Sequence
  source: /note="Description of Artificial Sequence: Synthetic oligonucleotide"
uacuucaaagacuguuuguuu

SEQ ID NO: 1635 - RNA, 21 nt, Artificial Sequence
  source: /note="Description of Artificial Sequence: Synthetic oligonucleotide"
auacuucaaagacuguuuguu

SEQ ID NO: 1636 - RNA, 21 nt, Artificial Sequence
  source: /note="Description of Artificial Sequence: Synthetic oligonucleotide"
uuguuuaaagacugggaggaa

SEQ ID NO: 1637 - RNA, 21 nt, Artificial Sequence
  source: /note="Description of Artificial Sequence: Synthetic oligonucleotide"
gcauacuucaaagacuguuua

SEQ ID NO: 1638 - RNA, 21 nt, Artificial Sequence
  source: /note="Description of Artificial Sequence: Synthetic oligonucleotide"
caaagacuguuuguuuaaaga

SEQ ID NO: 1639 - RNA, 21 nt, Artificial Sequence
  source: /note="Description of Artificial Sequence: Synthetic oligonucleotide"
agacuguuuguuuaaagacua

SEQ ID NO: 1640 - RNA, 21 nt, Artificial Sequence
  source: /note="Description of Artificial Sequence: Synthetic oligonucleotide"
guuuguuuaaagacugggaga

SEQ ID NO: 1641 - RNA, 21 nt, Artificial Sequence
  source: /note="Description of Artificial Sequence: Synthetic oligonucleotide"
gggggaggagauuagauuaaa

SEQ ID NO: 1642 - RNA, 21 nt, Artificial Sequence
  source: /note="Description of Artificial Sequence: Synthetic oligonucleotide"
ggggaggagauuagauuaaag

SEQ ID NO: 1643 - RNA, 21 nt, Artificial Sequence
  source: /note="Description of Artificial Sequence: Synthetic oligonucleotide"
guugggggaggagauuagauu

SEQ ID NO: 1644 - RNA, 21 nt, Artificial Sequence
  source: /note="Description of Artificial Sequence: Synthetic oligonucleotide"
uugggggaggagauuagauua

SEQ ID NO: 1645 - RNA, 21 nt, Artificial Sequence
  source: /note="Description of Artificial Sequence: Synthetic oligonucleotide"
gggaggagauuagauuaaaga

SEQ ID NO: 1646 - RNA, 21 nt, Artificial Sequence
  source: /note="Description of Artificial Sequence: Synthetic oligonucleotide"
uuagauuaaaggucuuuguaa

SEQ ID NO: 1647 - RNA, 21 nt, Artificial Sequence
  source: /note="Description of Artificial Sequence: Synthetic oligonucleotide"
uagauuaaaggucuuuguacu

SEQ ID NO: 1648 - RNA, 21 nt, Artificial Sequence
  source: /note="Description of Artificial Sequence: Synthetic oligonucleotide"
auuagauuaaaggucuuugua

SEQ ID NO: 1649 - RNA, 21 nt, Artificial Sequence
  source: /note="Description of Artificial Sequence: Synthetic oligonucleotide"
gaggagauuagauuaaaggua

SEQ ID NO: 1650 - RNA, 21 nt, Artificial Sequence
  source: /note="Description of Artificial Sequence: Synthetic oligonucleotide"
ggacucuuggacucucugcaa

SEQ ID NO: 1651 - RNA, 21 nt, Artificial Sequence
  source: /note="Description of Artificial Sequence: Synthetic oligonucleotide"
acucuuggacucucugcaaua

SEQ ID NO: 1652 - RNA, 21 nt, Artificial Sequence
  source: /note="Description of Artificial Sequence: Synthetic oligonucleotide"
agauuaaaggucuuuguacua

SEQ ID NO: 1653 - RNA, 23 nt, Artificial Sequence
  source: /note="Description of Artificial Sequence: Synthetic oligonucleotide"
agaggugaagcgaagugcacacg

SEQ ID NO: 1654 - RNA, 23 nt, Artificial Sequence
  source: /note="Description of Artificial Sequence: Synthetic oligonucleotide"
ucagaggugaagcgaagugcaca

SEQ ID NO: 1655 - RNA, 23 nt, Artificial Sequence
  source: /note="Description of Artificial Sequence: Synthetic oligonucleotide"
uaggugaagcgaagugcacacgg

SEQ ID NO: 1656 - RNA, 23 nt, Artificial Sequence
  source: /note="Description of Artificial Sequence: Synthetic oligonucleotide"
aggugaagcgaagugcacacggu

SEQ ID NO: 1657 - RNA, 23 nt, Artificial Sequence
  source: /note="Description of Artificial Sequence: Synthetic oligonucleotide"
uagaggugaagcgaagugcacac

SEQ ID NO: 1658 - RNA, 23 nt, Artificial Sequence
  source: /note="Description of Artificial Sequence: Synthetic oligonucleotide"
ugugaagcgaagugcacacgguc

SEQ ID NO: 1659 - RNA, 23 nt, Artificial Sequence
  source: /note="Description of Artificial Sequence: Synthetic oligonucleotide"
uugcagaggugaagcgaagugca

SEQ ID NO: 1660 - RNA, 23 nt, Artificial Sequence
  source: /note="Description of Artificial Sequence: Synthetic oligonucleotide"
ugugcagaggugaagcgaagugc

SEQ ID NO: 1661 - RNA, 23 nt, Artificial Sequence
  source: /note="Description of Artificial Sequence: Synthetic oligonucleotide"
uaccaauuuaugccuacagccuc

SEQ ID NO: 1662 - RNA, 23 nt, Artificial Sequence
  source: /note="Description of Artificial Sequence: Synthetic oligonucleotide"
uacgugcagaggugaagcgaagu

SEQ ID NO: 1663 - RNA, 23 nt, Artificial Sequence
  source: /note="Description of Artificial Sequence: Synthetic oligonucleotide"
ugacgugcagaggugaagcgaag

SEQ ID NO: 1664 - RNA, 23 nt, Artificial Sequence
  source: /note="Description of Artificial Sequence: Synthetic oligonucleotide"
acgugcagaggugaagcgaagug

SEQ ID NO: 1665 - RNA, 23 nt, Artificial Sequence
  source: /note="Description of Artificial Sequence: Synthetic oligonucleotide"
uaugagaaggcacagacggggag

SEQ ID NO: 1666 - RNA, 23 nt, Artificial Sequence
  source: /note="Description of Artificial Sequence: Synthetic oligonucleotide"
uagaugagaaggcacagacgggg

SEQ ID NO: 1667 - RNA, 23 nt, Artificial Sequence
  source: /note="Description of Artificial Sequence: Synthetic oligonucleotide"
uaaaaaguugcauggugcuggug

SEQ ID NO: 1668 - RNA, 23 nt, Artificial Sequence
  source: /note="Description of Artificial Sequence: Synthetic oligonucleotide"
aaaaguugcauggugcuggugcg

SEQ ID NO: 1669 - RNA, 23 nt, Artificial Sequence
  source: /note="Description of Artificial Sequence: Synthetic oligonucleotide"
aggugaaaaaguugcauggugcu

SEQ ID NO: 1670 - RNA, 23 nt, Artificial Sequence
  source: /note="Description of Artificial Sequence: Synthetic oligonucleotide"
uaaggucggucguugacauugca

SEQ ID NO: 1671 - RNA, 23 nt, Artificial Sequence
  source: /note="Description of Artificial Sequence: Synthetic oligonucleotide"
ucgacgugcagaggugaagcgaa

SEQ ID NO: 1672 - RNA, 23 nt, Artificial Sequence
  source: /note="Description of Artificial Sequence: Synthetic oligonucleotide"
cuuugaaguaugccucaaggucg

SEQ ID NO: 1673 - RNA, 23 nt, Artificial Sequence
  source: /note="Description of Artificial Sequence: Synthetic oligonucleotide"
ugaaguaugccucaaggucgguc

SEQ ID NO: 1674 - RNA, 23 nt, Artificial Sequence
  source: /note="Description of Artificial Sequence: Synthetic oligonucleotide"
uuugaaguaugccucaaggucgg

SEQ ID NO: 1675 - RNA, 23 nt, Artificial Sequence
  source: /note="Description of Artificial Sequence: Synthetic oligonucleotide"
uaaguaugccucaaggucggucg

SEQ ID NO: 1676 - RNA, 23 nt, Artificial Sequence
  source: /note="Description of Artificial Sequence: Synthetic oligonucleotide"
uucacgguggucuccaugcgacg

SEQ ID NO: 1677 - RNA, 23 nt, Artificial Sequence
  source: /note="Description of Artificial Sequence: Synthetic oligonucleotide"
uccaagaguccucuuauguaaga

SEQ ID NO: 1678 - RNA, 23 nt, Artificial Sequence
  source: /note="Description of Artificial Sequence: Synthetic oligonucleotide"
uaagaguccucuuauguaagacc

SEQ ID NO: 1679 - RNA, 23 nt, Artificial Sequence
  source: /note="Description of Artificial Sequence: Synthetic oligonucleotide"
uaaacaaacagucuuugaaguau

SEQ ID NO: 1680 - RNA, 23 nt, Artificial Sequence
  source: /note="Description of Artificial Sequence: Synthetic oligonucleotide"
aaacaaacagucuuugaaguaug

SEQ ID NO: 1681 - RNA, 23 nt, Artificial Sequence
  source: /note="Description of Artificial Sequence: Synthetic oligonucleotide"
aacaaacagucuuugaaguaugc

SEQ ID NO: 1682 - RNA, 23 nt, Artificial Sequence
  source: /note="Description of Artificial Sequence: Synthetic oligonucleotide"
uuccucccagucuuuaaacaaac

SEQ ID NO: 1683 - RNA, 23 nt, Artificial Sequence
  source: /note="Description of Artificial Sequence: Synthetic oligonucleotide"
uaaacagucuuugaaguaugccu

SEQ ID NO: 1684 - RNA, 23 nt, Artificial Sequence
  source: /note="Description of Artificial Sequence: Synthetic oligonucleotide"
ucuuuaaacaaacagucuuugaa

SEQ ID NO: 1685 - RNA, 23 nt, Artificial Sequence
  source: /note="Description of Artificial Sequence: Synthetic oligonucleotide"
uagucuuuaaacaaacagucuuu

SEQ ID NO: 1686 - RNA, 23 nt, Artificial Sequence
  source: /note="Description of Artificial Sequence: Synthetic oligonucleotide"
ucucccagucuuuaaacaaacag

SEQ ID NO: 1687 - RNA, 23 nt, Artificial Sequence
  source: /note="Description of Artificial Sequence: Synthetic oligonucleotide"
uuuaaucuaaucuccucccccaa

SEQ ID NO: 1688 - RNA, 23 nt, Artificial Sequence
  source: /note="Description of Artificial Sequence: Synthetic oligonucleotide"
cuuuaaucuaaucuccuccccca

SEQ ID NO: 1689 - RNA, 23 nt, Artificial Sequence
  source: /note="Description of Artificial Sequence: Synthetic oligonucleotide"
aaucuaaucuccucccccaacuc

SEQ ID NO: 1690 - RNA, 23 nt, Artificial Sequence
  source: /note="Description of Artificial Sequence: Synthetic oligonucleotide"
uaaucuaaucuccucccccaacu

SEQ ID NO: 1691 - RNA, 23 nt, Artificial Sequence
  source: /note="Description of Artificial Sequence: Synthetic oligonucleotide"
ucuuuaaucuaaucuccuccccc

SEQ ID NO: 1692 - RNA, 23 nt, Artificial Sequence
  source: /note="Description of Artificial Sequence: Synthetic oligonucleotide"
uuacaaagaccuuuaaucuaauc

SEQ ID NO: 1693 - RNA, 23 nt, Artificial Sequence
  source: /note="Description of Artificial Sequence: Synthetic oligonucleotide"
aguacaaagaccuuuaaucuaau

SEQ ID NO: 1694 - RNA, 23 nt, Artificial Sequence
  source: /note="Description of Artificial Sequence: Synthetic oligonucleotide"
uacaaagaccuuuaaucuaaucu

SEQ ID NO: 1695 - RNA, 23 nt, Artificial Sequence
  source: /note="Description of Artificial Sequence: Synthetic oligonucleotide"
uaccuuuaaucuaaucuccuccc

SEQ ID NO: 1696 - RNA, 23 nt, Artificial Sequence
  source: /note="Description of Artificial Sequence: Synthetic oligonucleotide"
uugcagagaguccaagaguccuc

SEQ ID NO: 1697 - RNA, 23 nt, Artificial Sequence
  source: /note="Description of Artificial Sequence: Synthetic oligonucleotide"
uauugcagagaguccaagagucc

SEQ ID NO: 1698 - RNA, 23 nt, Artificial Sequence
  source: /note="Description of Artificial Sequence: Synthetic oligonucleotide"
uaguacaaagaccuuuaaucuaa

SEQ ID NO: 1699 - RNA, 21 nt, Artificial Sequence
  source: /note="Description of Artificial Sequence: Synthetic oligonucleotide"
ugugcacuucgcuucaccucu

SEQ ID NO: 1700 - RNA, 21 nt, Artificial Sequence
  source: /note="Description of Artificial Sequence: Synthetic oligonucleotide"
ugcacuucgcuucaccucuga

SEQ ID NO: 1701 - RNA, 21 nt, Artificial Sequence
  source: /note="Description of Artificial Sequence: Synthetic oligonucleotide"
gugugcacuucgcuucaccua

SEQ ID NO: 1702 - RNA, 21 nt, Artificial Sequence
  source: /note="Description of Artificial Sequence: Synthetic oligonucleotide"
cgugugcacuucgcuucaccu

SEQ ID NO: 1703 - RNA, 21 nt, Artificial Sequence
  source: /note="Description of Artificial Sequence: Synthetic oligonucleotide"
gugcacuucgcuucaccucua

SEQ ID NO: 1704 - RNA, 21 nt, Artificial Sequence
  source: /note="Description of Artificial Sequence: Synthetic oligonucleotide"
ccgugugcacuucgcuucaca

SEQ ID NO: 1705 - RNA, 21 nt, Artificial Sequence
  source: /note="Description of Artificial Sequence: Synthetic oligonucleotide"
cacuucgcuucaccucugcaa

SEQ ID NO: 1706 - RNA, 21 nt, Artificial Sequence
  source: /note="Description of Artificial Sequence: Synthetic oligonucleotide"
acuucgcuucaccucugcaca

SEQ ID NO: 1707 - RNA, 21 nt, Artificial Sequence
  source: /note="Description of Artificial Sequence: Synthetic oligonucleotide"
ggcuguaggcauaaauuggua

SEQ ID NO: 1708 - RNA, 21 nt, Artificial Sequence
  source: /note="Description of Artificial Sequence: Synthetic oligonucleotide"
uucgcuucaccucugcacgua

SEQ ID NO: 1709 - RNA, 21 nt, Artificial Sequence
  source: /note="Description of Artificial Sequence: Synthetic oligonucleotide"
ucgcuucaccucugcacguca

SEQ ID NO: 1710 - RNA, 21 nt, Artificial Sequence
  source: /note="Description of Artificial Sequence: Synthetic oligonucleotide"
cuucgcuucaccucugcacgu

SEQ ID NO: 1711 - RNA, 21 nt, Artificial Sequence
  source: /note="Description of Artificial Sequence: Synthetic oligonucleotide"
ccccgucugugccuucucaua

SEQ ID NO: 1712 - RNA, 21 nt, Artificial Sequence
  source: /note="Description of Artificial Sequence: Synthetic oligonucleotide"
ccgucugugccuucucaucua

SEQ ID NO: 1713 - RNA, 21 nt, Artificial Sequence
  source: /note="Description of Artificial Sequence: Synthetic oligonucleotide"
ccagcaccaugcaacuuuuua

SEQ ID NO: 1714 - RNA, 21 nt, Artificial Sequence
  source: /note="Description of Artificial Sequence: Synthetic oligonucleotide"
caccagcaccaugcaacuuuu

SEQ ID NO: 1715 - RNA, 21 nt, Artificial Sequence
  source: /note="Description of Artificial Sequence: Synthetic oligonucleotide"
caccaugcaacuuuuucaccu

SEQ ID NO: 1716 - RNA, 21 nt, Artificial Sequence
  source: /note="Description of Artificial Sequence: Synthetic oligonucleotide"
caaugucaacgaccgaccuua

SEQ ID NO: 1717 - RNA, 21 nt, Artificial Sequence
  source: /note="Description of Artificial Sequence: Synthetic oligonucleotide"
cgcuucaccucugcacgucga

SEQ ID NO: 1718 - RNA, 21 nt, Artificial Sequence
  source: /note="Description of Artificial Sequence: Synthetic oligonucleotide"
accuugaggcauacuucaaag

SEQ ID NO: 1719 - RNA, 21 nt, Artificial Sequence
  source: /note="Description of Artificial Sequence: Synthetic oligonucleotide"
ccgaccuugaggcauacuuca

SEQ ID NO: 1720 - RNA, 21 nt, Artificial Sequence
  source: /note="Description of Artificial Sequence: Synthetic oligonucleotide"
gaccuugaggcauacuucaaa

SEQ ID NO: 1721 - RNA, 21 nt, Artificial Sequence
  source: /note="Description of Artificial Sequence: Synthetic oligonucleotide"
accgaccuugaggcauacuua

SEQ ID NO: 1722 - RNA, 21 nt, Artificial Sequence
  source: /note="Description of Artificial Sequence: Synthetic oligonucleotide"
ucgcauggagaccaccgugaa

SEQ ID NO: 1723 - RNA, 21 nt, Artificial Sequence
  source: /note="Description of Artificial Sequence: Synthetic oligonucleotide"
uuacauaagaggacucuugga

SEQ ID NO: 1724 - RNA, 21 nt, Artificial Sequence
  source: /note="Description of Artificial Sequence: Synthetic oligonucleotide"
ucuuacauaagaggacucuua

SEQ ID NO: 1725 - RNA, 21 nt, Artificial Sequence
  source: /note="Description of Artificial Sequence: Synthetic oligonucleotide"
acuucaaagacuguuuguuua

SEQ ID NO: 1726 - RNA, 21 nt, Artificial Sequence
  source: /note="Description of Artificial Sequence: Synthetic oligonucleotide"
uacuucaaagacuguuuguuu

SEQ ID NO: 1727 - RNA, 21 nt, Artificial Sequence
  source: /note="Description of Artificial Sequence: Synthetic oligonucleotide"
auacuucaaagacuguuuguu

SEQ ID NO: 1728 - RNA, 21 nt, Artificial Sequence
  source: /note="Description of Artificial Sequence: Synthetic oligonucleotide"
uuguuuaaagacugggaggaa

SEQ ID NO: 1729 - RNA, 21 nt, Artificial Sequence
  source: /note="Description of Artificial Sequence: Synthetic oligonucleotide"
gcauacuucaaagacuguuua

SEQ ID NO: 1730 - RNA, 21 nt, Artificial Sequence
  source: /note="Description of Artificial Sequence: Synthetic oligonucleotide"
caaagacuguuuguuuaaaga

SEQ ID NO: 1731 - RNA, 21 nt, Artificial Sequence
  source: /note="Description of Artificial Sequence: Synthetic oligonucleotide"
agacuguuuguuuaaagacua

SEQ ID NO: 1732 - RNA, 21 nt, Artificial Sequence
  source: /note="Description of Artificial Sequence: Synthetic oligonucleotide"
guuuguuuaaagacugggaga

SEQ ID NO: 1733 - RNA, 21 nt, Artificial Sequence
  source: /note="Description of Artificial Sequence: Synthetic oligonucleotide"
gggggaggagauuagauuaaa

SEQ ID NO: 1734 - RNA, 21 nt, Artificial Sequence
  source: /note="Description of Artificial Sequence: Synthetic oligonucleotide"
ggggaggagauuagauuaaag

SEQ ID NO: 1735 - RNA, 21 nt, Artificial Sequence
  source: /note="Description of Artificial Sequence: Synthetic oligonucleotide"
guugggggaggagauuagauu

SEQ ID NO: 1736 - RNA, 21 nt, Artificial Sequence
  source: /note="Description of Artificial Sequence: Synthetic oligonucleotide"
uugggggaggagauuagauua

SEQ ID NO: 1737 - RNA, 21 nt, Artificial Sequence
  source: /note="Description of Artificial Sequence: Synthetic oligonucleotide"
gggaggagauuagauuaaaga

SEQ ID NO: 1738 - RNA, 21 nt, Artificial Sequence
  source: /note="Description of Artificial Sequence: Synthetic oligonucleotide"
uuagauuaaaggucuuuguaa

SEQ ID NO: 1739 - RNA, 21 nt, Artificial Sequence
  source: /note="Description of Artificial Sequence: Synthetic oligonucleotide"
uagauuaaaggucuuuguacu

SEQ ID NO: 1740 - RNA, 21 nt, Artificial Sequence
  source: /note="Description of Artificial Sequence: Synthetic oligonucleotide"
auuagauuaaaggucuuugua

SEQ ID NO: 1741 - RNA, 21 nt, Artificial Sequence
  source: /note="Description of Artificial Sequence: Synthetic oligonucleotide"
gaggagauuagauuaaaggua

SEQ ID NO: 1742 - RNA, 21 nt, Artificial Sequence
  source: /note="Description of Artificial Sequence: Synthetic oligonucleotide"
ggacucuuggacucucugcaa

SEQ ID NO: 1743 - RNA, 21 nt, Artificial Sequence
  source: /note="Description of Artificial Sequence: Synthetic oligonucleotide"
acucuuggacucucugcaaua

SEQ ID NO: 1744 - RNA, 21 nt, Artificial Sequence
  source: /note="Description of Artificial Sequence: Synthetic oligonucleotide"
agauuaaaggucuuuguacua

SEQ ID NO: 1745 - RNA, 23 nt, Artificial Sequence
  source: /note="Description of Artificial Sequence: Synthetic oligonucleotide"
agaggugaagcgaagugcacacg

SEQ ID NO: 1746 - RNA, 23 nt, Artificial Sequence
  source: /note="Description of Artificial Sequence: Synthetic oligonucleotide"
ucagaggugaagcgaagugcaca

SEQ ID NO: 1747 - RNA, 23 nt, Artificial Sequence
  source: /note="Description of Artificial Sequence: Synthetic oligonucleotide"
uaggugaagcgaagugcacacgg

SEQ ID NO: 1748 - RNA, 23 nt, Artificial Sequence
  source: /note="Description of Artificial Sequence: Synthetic oligonucleotide"
aggugaagcgaagugcacacggu

SEQ ID NO: 1749 - RNA, 23 nt, Artificial Sequence
  source: /note="Description of Artificial Sequence: Synthetic oligonucleotide"
uagaggugaagcgaagugcacac

SEQ ID NO: 1750 - RNA, 23 nt, Artificial Sequence
  source: /note="Description of Artificial Sequence: Synthetic oligonucleotide"
ugugaagcgaagugcacacgguc

SEQ ID NO: 1751 - RNA, 23 nt, Artificial Sequence
  source: /note="Description of Artificial Sequence: Synthetic oligonucleotide"
uugcagaggugaagcgaagugca

SEQ ID NO: 1752 - RNA, 23 nt, Artificial Sequence
  source: /note="Description of Artificial Sequence: Synthetic oligonucleotide"
ugugcagaggugaagcgaagugc

SEQ ID NO: 1753 - RNA, 23 nt, Artificial Sequence
  source: /note="Description of Artificial Sequence: Synthetic oligonucleotide"
uaccaauuuaugccuacagccuc

SEQ ID NO: 1754 - RNA, 23 nt, Artificial Sequence
  source: /note="Description of Artificial Sequence: Synthetic oligonucleotide"
uacgugcagaggugaagcgaagu

SEQ ID NO: 1755 - RNA, 23 nt, Artificial Sequence
  source: /note="Description of Artificial Sequence: Synthetic oligonucleotide"
ugacgugcagaggugaagcgaag

SEQ ID NO: 1756 - RNA, 23 nt, Artificial Sequence
  source: /note="Description of Artificial Sequence: Synthetic oligonucleotide"
acgugcagaggugaagcgaagug

SEQ ID NO: 1757 - RNA, 23 nt, Artificial Sequence
  source: /note="Description of Artificial Sequence: Synthetic oligonucleotide"
uaugagaaggcacagacggggag

SEQ ID NO: 1758 - RNA, 23 nt, Artificial Sequence
  source: /note="Description of Artificial Sequence: Synthetic oligonucleotide"
uagaugagaaggcacagacgggg

SEQ ID NO: 1759 - RNA, 23 nt, Artificial Sequence
  source: /note="Description of Artificial Sequence: Synthetic oligonucleotide"
uaaaaaguugcauggugcuggug

SEQ ID NO: 1760 - RNA, 23 nt, Artificial Sequence
  source: /note="Description of Artificial Sequence: Synthetic oligonucleotide"
aaaaguugcauggugcuggugcg

SEQ ID NO: 1761 - RNA, 23 nt, Artificial Sequence
  source: /note="Description of Artificial Sequence: Synthetic oligonucleotide"
aggugaaaaaguugcauggugcu

SEQ ID NO: 1762 - RNA, 23 nt, Artificial Sequence
  source: /note="Description of Artificial Sequence: Synthetic oligonucleotide"
uaaggucggucguugacauugca

SEQ ID NO: 1763 - RNA, 23 nt, Artificial Sequence
  source: /note="Description of Artificial Sequence: Synthetic oligonucleotide"
ucgacgugcagaggugaagcgaa

SEQ ID NO: 1764 - RNA, 23 nt, Artificial Sequence
  source: /note="Description of Artificial Sequence: Synthetic oligonucleotide"
cuuugaaguaugccucaaggucg

SEQ ID NO: 1765 - RNA, 23 nt, Artificial Sequence
  source: /note="Description of Artificial Sequence: Synthetic oligonucleotide"
ugaaguaugccucaaggucgguc

SEQ ID NO: 1766 - RNA, 23 nt, Artificial Sequence
  source: /note="Description of Artificial Sequence: Synthetic oligonucleotide"
uuugaaguaugccucaaggucgg

SEQ ID NO: 1767 - RNA, 23 nt, Artificial Sequence
  source: /note="Description of Artificial Sequence: Synthetic oligonucleotide"
uaaguaugccucaaggucggucg

SEQ ID NO: 1768 - RNA, 23 nt, Artificial Sequence
  source: /note="Description of Artificial Sequence: Synthetic oligonucleotide"
uucacgguggucuccaugcgacg

SEQ ID NO: 1769 - RNA, 23 nt, Artificial Sequence
  source: /note="Description of Artificial Sequence: Synthetic oligonucleotide"
uccaagaguccucuuauguaaga

SEQ ID NO: 1770 - RNA, 23 nt, Artificial Sequence
  source: /note="Description of Artificial Sequence: Synthetic oligonucleotide"
uaagaguccucuuauguaagacc

SEQ ID NO: 1771 - RNA, 23 nt, Artificial Sequence
  source: /note="Description of Artificial Sequence: Synthetic oligonucleotide"
uaaacaaacagucuuugaaguau

SEQ ID NO: 1772 - RNA, 23 nt, Artificial Sequence
  source: /note="Description of Artificial Sequence: Synthetic oligonucleotide"
aaacaaacagucuuugaaguaug

SEQ ID NO: 1773 - RNA, 23 nt, Artificial Sequence
  source: /note="Description of Artificial Sequence: Synthetic oligonucleotide"
aacaaacagucuuugaaguaugc

SEQ ID NO: 1774 - RNA, 23 nt, Artificial Sequence
  source: /note="Description of Artificial Sequence: Synthetic oligonucleotide"
uuccucccagucuuuaaacaaac

SEQ ID NO: 1775 - RNA, 23 nt, Artificial Sequence
  source: /note="Description of Artificial Sequence: Synthetic oligonucleotide"
uaaacagucuuugaaguaugccu

SEQ ID NO: 1776 - RNA, 23 nt, Artificial Sequence
  source: /note="Description of Artificial Sequence: Synthetic oligonucleotide"
ucuuuaaacaaacagucuuugaa

SEQ ID NO: 1777 - RNA, 23 nt, Artificial Sequence
  source: /note="Description of Artificial Sequence: Synthetic oligonucleotide"
uagucuuuaaacaaacagucuuu

SEQ ID NO: 1778 - RNA, 23 nt, Artificial Sequence
  source: /note="Description of Artificial Sequence: Synthetic oligonucleotide"
ucucccagucuuuaaacaaacag

SEQ ID NO: 1779 - RNA, 23 nt, Artificial Sequence
  source: /note="Description of Artificial Sequence: Synthetic oligonucleotide"
uuuaaucuaaucuccucccccaa

SEQ ID NO: 1780 - RNA, 23 nt, Artificial Sequence
  source: /note="Description of Artificial Sequence: Synthetic oligonucleotide"
cuuuaaucuaaucuccuccccca

SEQ ID NO: 1781 - RNA, 23 nt, Artificial Sequence
  source: /note="Description of Artificial Sequence: Synthetic oligonucleotide"
aaucuaaucuccucccccaacuc

SEQ ID NO: 1782 - RNA, 23 nt, Artificial Sequence
  source: /note="Description of Artificial Sequence: Synthetic oligonucleotide"
uaaucuaaucuccucccccaacu

SEQ ID NO: 1783 - RNA, 23 nt, Artificial Sequence
  source: /note="Description of Artificial Sequence: Synthetic oligonucleotide"
ucuuuaaucuaaucuccuccccc

SEQ ID NO: 1784 - RNA, 23 nt, Artificial Sequence
  source: /note="Description of Artificial Sequence: Synthetic oligonucleotide"
uuacaaagaccuuuaaucuaauc

SEQ ID NO: 1785 - RNA, 23 nt, Artificial Sequence
  source: /note="Description of Artificial Sequence: Synthetic oligonucleotide"
aguacaaagaccuuuaaucuaau

SEQ ID NO: 1786 - RNA, 23 nt, Artificial Sequence
  source: /note="Description of Artificial Sequence: Synthetic oligonucleotide"
uacaaagaccuuuaaucuaaucu

SEQ ID NO: 1787 - RNA, 23 nt, Artificial Sequence
  source: /note="Description of Artificial Sequence: Synthetic oligonucleotide"
uaccuuuaaucuaaucuccuccc

SEQ ID NO: 1788 - RNA, 23 nt, Artificial Sequence
  source: /note="Description of Artificial Sequence: Synthetic oligonucleotide"
uugcagagaguccaagaguccuc

SEQ ID NO: 1789 - RNA, 23 nt, Artificial Sequence
  source: /note="Description of Artificial Sequence: Synthetic oligonucleotide"
uauugcagagaguccaagagucc

SEQ ID NO: 1790 - RNA, 23 nt, Artificial Sequence
  source: /note="Description of Artificial Sequence: Synthetic oligonucleotide"
uaguacaaagaccuuuaaucuaa

SEQ ID NO: 1791 - RNA, 19 nt, Artificial Sequence
  source: /note="Description of Artificial Sequence: Synthetic oligonucleotide"
gucugugccuucucaucua

SEQ ID NO: 1792 - RNA, 19 nt, Artificial Sequence
  source: /note="Description of Artificial Sequence: Synthetic oligonucleotide"
gucugugccuucucaucua

SEQ ID NO: 1793 - RNA, 19 nt, Artificial Sequence
  source: /note="Description of Artificial Sequence: Synthetic oligonucleotide"
gugugcacuucgcuucaca

SEQ ID NO: 1794 - RNA, 19 nt, Artificial Sequence
  source: /note="Description of Artificial Sequence: Synthetic oligonucleotide"
gugugcacuucgcuucaca

SEQ ID NO: 1795 - RNA, 21 nt, Artificial Sequence
  source: /note="Description of Artificial Sequence: Synthetic oligonucleotide"
ugugcacuucgcuucaccucu

SEQ ID NO: 1796 - RNA, 21 nt, Artificial Sequence
  source: /note="Description of Artificial Sequence: Synthetic oligonucleotide"
ugugcacuucgcuucaccucu

SEQ ID NO: 1797 - RNA, 21 nt, Artificial Sequence
  source: /note="Description of Artificial Sequence: Synthetic oligonucleotide"
caccagcaccaugcaacuuuu

SEQ ID NO: 1798 - RNA, 21 nt, Artificial Sequence
  source: /note="Description of Artificial Sequence: Synthetic oligonucleotide"
caccagcaccaugcaacuuuu

SEQ ID NO: 1799 - RNA, 21 nt, Artificial Sequence
  source: /note="Description of Artificial Sequence: Synthetic oligonucleotide"
caccaugcaacuuuuucaccu

SEQ ID NO: 1800 - RNA, 21 nt, Artificial Sequence
  source: /note="Description of Artificial Sequence: Synthetic oligonucleotide"
caccaugcaacuuuuucaccu

SEQ ID NO: 1801 - RNA, 21 nt, Artificial Sequence
  source: /note="Description of Artificial Sequence: Synthetic oligonucleotide"
uagaugagaaggcacagacuu

SEQ ID NO: 1802 - RNA, 21 nt, Artificial Sequence
  source: /note="Description of Artificial Sequence: Synthetic oligonucleotide"
uagaugagaaggcacagacuu

SEQ ID NO: 1803 - RNA, 21 nt, Artificial Sequence
  source: /note="Description of Artificial Sequence: Synthetic oligonucleotide"
ugugaagcgaagugcacacuu

SEQ ID NO: 1804 - RNA, 21 nt, Artificial Sequence
  source: /note="Description of Artificial Sequence: Synthetic oligonucleotide"
ugugaagcgaagugcacacuu

SEQ ID NO: 1805 - RNA, 23 nt, Artificial Sequence
  source: /note="Description of Artificial Sequence: Synthetic oligonucleotide"
agaggugaagcgaagugcacauu

SEQ ID NO: 1806 - RNA, 23 nt, Artificial Sequence
  source: /note="Description of Artificial Sequence: Synthetic oligonucleotide"
agaggugaagcgaagugcacauu

SEQ ID NO: 1807 - RNA, 23 nt, Artificial Sequence
  source: /note="Description of Artificial Sequence: Synthetic oligonucleotide"
aaaaguugcauggugcugguguu

SEQ ID NO: 1808 - RNA, 23 nt, Artificial Sequence
  source: /note="Description of Artificial Sequence: Synthetic oligonucleotide"
aaaaguugcauggugcugguguu

SEQ ID NO: 1809 - RNA, 23 nt, Artificial Sequence
  source: /note="Description of Artificial Sequence: Synthetic oligonucleotide"
aggugaaaaaguugcaugguguu

SEQ ID NO: 1810 - RNA, 23 nt, Artificial Sequence
  source: /note="Description of Artificial Sequence: Synthetic oligonucleotide"
aggugaaaaaguugcaugguguu

SEQ ID NO: 1811 - RNA, 19 nt, Artificial Sequence
  source: /note="Description of Artificial Sequence: Synthetic oligonucleotide"
gucugugccuucucaucua

SEQ ID NO: 1812 - RNA, 19 nt, Artificial Sequence
  source: /note="Description of Artificial Sequence: Synthetic oligonucleotide"
gucugugccuucucaucua

SEQ ID NO: 1813 - RNA, 19 nt, Artificial Sequence
  source: /note="Description of Artificial Sequence: Synthetic oligonucleotide"
gugugcacuucgcuucaca

SEQ ID NO: 1814 - RNA, 19 nt, Artificial Sequence
  source: /note="Description of Artificial Sequence: Synthetic oligonucleotide"
gugugcacuucgcuucaca

SEQ ID NO: 1815 - RNA, 21 nt, Artificial Sequence
  source: /note="Description of Artificial Sequence: Synthetic oligonucleotide"
ugugcacuucgcuucaccucu

SEQ ID NO: 1816 - RNA, 21 nt, Artificial Sequence
  source: /note="Description of Artificial Sequence: Synthetic oligonucleotide"
ugugcacuucgcuucaccucu

SEQ ID NO: 1817 - RNA, 21 nt, Artificial Sequence
  source: /note="Description of Artificial Sequence: Synthetic oligonucleotide"
caccagcaccaugcaacuuuu

SEQ ID NO: 1818 - RNA, 21 nt, Artificial Sequence
  source: /note="Description of Artificial Sequence: Synthetic oligonucleotide"
caccagcaccaugcaacuuuu

SEQ ID NO: 1819 - RNA, 21 nt, Artificial Sequence
  source: /note="Description of Artificial Sequence: Synthetic oligonucleotide"
caccaugcaacuuuuucaccu

SEQ ID NO: 1820 - RNA, 21 nt, Artificial Sequence
  source: /note="Description of Artificial Sequence: Synthetic oligonucleotide"
caccaugcaacuuuuucaccu

SEQ ID NO: 1821 - RNA, 21 nt, Artificial Sequence
  source: /note="Description of Artificial Sequence: Synthetic oligonucleotide"
uagaugagaaggcacagacuu

SEQ ID NO: 1822 - RNA, 21 nt, Artificial Sequence
  source: /note="Description of Artificial Sequence: Synthetic oligonucleotide"
uagaugagaaggcacagacuu

SEQ ID NO: 1823 - RNA, 21 nt, Artificial Sequence
  source: /note="Description of Artificial Sequence: Synthetic oligonucleotide"
ugugaagcgaagugcacacuu

SEQ ID NO: 1824 - RNA, 21 nt, Artificial Sequence
  source: /note="Description of Artificial Sequence: Synthetic oligonucleotide"
ugugaagcgaagugcacacuu

SEQ ID NO: 1825 - RNA, 23 nt, Artificial Sequence
  source: /note="Description of Artificial Sequence: Synthetic oligonucleotide"
agaggugaagcgaagugcacauu

SEQ ID NO: 1826 - RNA, 23 nt, Artificial Sequence
  source: /note="Description of Artificial Sequence: Synthetic oligonucleotide"
agaggugaagcgaagugcacauu

SEQ ID NO: 1827 - RNA, 23 nt, Artificial Sequence
  source: /note="Description of Artificial Sequence: Synthetic oligonucleotide"
aaaaguugcauggugcugguguu

SEQ ID NO: 1828 - RNA, 23 nt, Artificial Sequence
  source: /note="Description of Artificial Sequence: Synthetic oligonucleotide"
aaaaguugcauggugcugguguu

SEQ ID NO: 1829 - RNA, 23 nt, Artificial Sequence
  source: /note="Description of Artificial Sequence: Synthetic oligonucleotide"
aggugaaaaaguugcaugguguu

SEQ ID NO: 1830 - RNA, 23 nt, Artificial Sequence
  source: /note="Description of Artificial Sequence: Synthetic oligonucleotide"
aggugaaaaaguugcaugguguu

SEQ ID NO: 1831 - protein, 16 aa, Unknown
  source: /note="Description of Unknown: RFGF peptide"
AAVALLPAVLLALLAP

SEQ ID NO: 1832 - protein, 11 aa, Unknown
  source: /note="Description of Unknown: RFGF analogue peptide"
AALLPVLLAAP

SEQ ID NO: 1833 - protein, 13 aa, Human immunodeficiency virus
GRKKRRQRRRPPQ

SEQ ID NO: 1834 - protein, 16 aa, Drosophila sp.
RQIKIWFQNRRMKWKK

SEQ ID NO: 1835 - DNA, 1692 bp, Artificial Sequence
  source: /note="Description of Artificial Sequence: Synthetic polynucleotide"
gcgatcgcctcgaacttgggcggcgagtccagcagtctcctctttatcagaaaagagtaagagcactgaggactgccgcctcttgtcgagatgagccggtccgagttgaagaagaagcgcgatggaagagaagatattctcgagaagtgggtgagtggaagaaagaaagcggaggaactcgagagggatctccggaagacaaagaagaagatcaagaaacttgaggtcgaaaatccctggctgggaaacatcaaaggaattctcggaaagaaggacagggatggagagggggctcccccggcgaagagggcccggacggaccagatggagatagactccgggcctaggaagaggcctctcaggggaggattcaccgacagggagaggcaggatcaccgacgaaggaaggccctcgagaacaagaagaagcagctagccgcgggagggaagagcctgagcaaggaggaggaagaggaactcggaaggttgacccgggaagacgaggaaaggaaaagaagagtagccggcccgcgggttgggggtgtgaaccccctcgaaggcggatcgaggggagcgcccgggggcggcttcgtccccagcatgcaaggagtcccggagtcccccttcgctcggacgggggaggggctggacataagaggaacccggggattcccataggatatactcttcccatccgatccacccttctctccccagagttgtcgtccccagtgaataaagcgggtttccactcacaggttcaccgtctcgcgtccttctttcctcttcgggtcggcatggcatctccacctcctcgcggtccgacctgggcatccgaaggaggacgcacgtccactcggatggctaagggagagccacttttctctcgattctctatcggaatctagagagatttgtgggtcccattcgccattaccgaggggacggtcccctcggaatgttgcccagccggcgccagcgaggaggctgggaccatgccggccatcaggtaagaaaggatggaacgcggaccctgcagagtggggtcccgccattcctgggcgacccttggggggggagtcggaatcgagcatcgggaagggcatcccatggctccactggtccccggtgttcccagcaccccctccggtcactttcgaagggggtccggggtcccgctagatggggacgataagtcgagttccccgggataagcctcactcgtcccctctcggggggcggaacacccaccggctagccccgttgctttctttgctttcctcctcgcttcggtctccccctactcctagcatctcctcctatcgctatggccttactcctaccgctcgaagcgcctctgttcgctgaaggggtcctctggaggtgatttctctgctcatctccgagtgtgttcctccctctggtgttctcaacccttcggccggagtgctctccaaacttgggcgtcgggcctttcggatcgggggggcccccccttctcttccatctgtcctctttccccttccgagatgtctccagcgttatggggaaagcttccgactcttgtattctcttttggccttcttgggagacatctcctcggcgttccaatactctttaccactttacccctctcgggcactgatccttcccccgcggactcttcgctcggaattggcccatggcggccgc

SEQ ID NO: 1836 - DNA, 1692 bp, Artificial Sequence
  source: /note="Description of Artificial Sequence: Synthetic polynucleotide"
gcgatcgccatgggccaattccgagcgaagagtccgcgggggaaggatcagtgcccgagaggggtaaagtggtaaagagtattggaacgccgaggagatgtctcccaagaaggccaaaagagaatacaagagtcggaagctttccccataacgctggagacatctcggaaggggaaagaggacagatggaagagaagggggggcccccccgatccgaaaggcccgacgcccaagtttggagagcactccggccgaagggttgagaacaccagagggaggaacacactcggagatgagcagagaaatcacctccagaggaccccttcagcgaacagaggcgcttcgagcggtaggagtaaggccatagcgataggaggagatgctaggagtagggggagaccgaagcgaggaggaaagcaaagaaagcaacggggctagccggtgggtgttccgccccccgagaggggacgagtgaggcttatcccggggaactcgacttatcgtccccatctagcgggaccccggacccccttcgaaagtgaccggagggggtgctgggaacaccggggaccagtggagccatgggatgcccttcccgatgctcgattccgactccccccccaagggtcgcccaggaatggcgggaccccactctgcagggtccgcgttccatcctttcttacctgatggccggcatggtcccagcctcctcgctggcgccggctgggcaacattccgaggggaccgtcccctcggtaatggcgaatgggacccacaaatctctctagattccgatagagaatcgagagaaaagtggctctcccttagccatccgagtggacgtgcgtcctccttcggatgcccaggtcggaccgcgaggaggtggagatgccatgccgacccgaagaggaaagaaggacgcgagacggtgaacctgtgagtggaaacccgctttattcactggggacgacaactctggggagagaagggtggatcggatgggaagagtatatcctatgggaatccccgggttcctcttatgtccagcccctcccccgtccgagcgaagggggactccgggactccttgcatgctggggacgaagccgcccccgggcgctcccctcgatccgccttcgagggggttcacacccccaacccgcgggccggctactcttcttttcctttcctcgtcttcccgggtcaaccttccgagttcctcttcctcctccttgctcaggctcttccctcccgcggctagctgcttcttcttgttctcgagggccttccttcgtcggtgatcctgcctctccctgtcggtgaatcctcccctgagaggcctcttcctaggcccggagtctatctccatctggtccgtccgggccctcttcgccgggggagccccctctccatccctgtccttctttccgagaattcctttgatgtttcccagccagggattttcgacctcaagtttcttgatcttcttctttgtcttccggagatccctctcgagttcctccgctttctttcttccactcacccacttctcgagaatatcttctcttccatcgcgcttcttcttcaactcggaccggctcatctcgacaagaggcggcagtcctcagtgctcttactcttttctgataaagaggagactgctggactcgccgcccaagttcgaggcggccgc

SEQ ID NO: 1837 - DNA, 105 bp, Artificial Sequence
  source: /note="Description of Artificial Sequence: Synthetic polynucleotide"
gcgatcgcgaagacaaagaagaagatcaagaaacttgaggtcgaaaatccctggctgggaaacatcaaaggaattctcggaaagaaggacagggatggcggccgc

SEQ ID NO: 1838 - DNA, 105 bp, Artificial Sequence
  source: /note="Description of Artificial Sequence: Synthetic polynucleotide"
gcgatcgccatccctgtccttctttccgagaattcctttgatgtttcccagccagggattttcgacctcaagtttcttgatcttcttctttgtcttcgcggccgc

SEQ ID NO: 1839 - RNA, 21 nt, Artificial Sequence
  source: /note="Description of Artificial Sequence: Synthetic oligonucleotide"
ucccaagaaggccaaaagaga

SEQ ID NO: 1840 - RNA, 21 nt, Artificial Sequence
  source: /note="Description of Artificial Sequence: Synthetic oligonucleotide"
aguuucuugaucuucuucuuu

SEQ ID NO: 1841 - RNA, 21 nt, Artificial Sequence
  source: /note="Description of Artificial Sequence: Synthetic oligonucleotide"
ucuuuucugauaaagaggaga

SEQ ID NO: 1842 - RNA, 21 nt, Artificial Sequence
  source: /note="Description of Artificial Sequence: Synthetic oligonucleotide"
agugguaaagaguauuggaaa

SEQ ID NO: 1843 - RNA, 21 nt, Artificial Sequence
  source: /note="Description of Artificial Sequence: Synthetic oligonucleotide"
cucaaguuucuugaucuucuu

SEQ ID NO: 1844 - RNA, 21 nt, Artificial Sequence
  source: /note="Description of Artificial Sequence: Synthetic oligonucleotide"
aaggccaaaagagaauacaaa

SEQ ID NO: 1845 - RNA, 21 nt, Artificial Sequence
  source: /note="Description of Artificial Sequence: Synthetic oligonucleotide"
gaccucaaguuucuugaucuu

SEQ ID NO: 1846 - RNA, 21 nt, Artificial Sequence
  source: /note="Description of Artificial Sequence: Synthetic oligonucleotide"
aggccaaaagagaauacaaga

SEQ ID NO: 1847 - RNA, 21 nt, Artificial Sequence
  source: /note="Description of Artificial Sequence: Synthetic oligonucleotide"
cgauagagaaucgagagaaaa

SEQ ID NO: 1848 - RNA, 21 nt, Artificial Sequence
  source: /note="Description of Artificial Sequence: Synthetic oligonucleotide"
gauagagaaucgagagaaaag

SEQ ID NO: 1849 - RNA, 21 nt, Artificial Sequence
  source: /note="Description of Artificial Sequence: Synthetic oligonucleotide"
acccacaaaucucucuagauu

SEQ ID NO: 1850 - RNA, 21 nt, Artificial Sequence
  source: /note="Description of Artificial Sequence: Synthetic oligonucleotide"
ggaugggaagaguauauccua

SEQ ID NO: 1851 - RNA, 21 nt, Artificial Sequence
  source: /note="Description of Artificial Sequence: Synthetic oligonucleotide"
ccgauagagaaucgagagaaa

SEQ ID NO: 1852 - RNA, 21 nt, Artificial Sequence
  source: /note="Description of Artificial Sequence: Synthetic oligonucleotide"
uccgauagagaaucgagagaa

SEQ ID NO: 1853 - RNA, 21 nt, Artificial Sequence
  source: /note="Description of Artificial Sequence: Synthetic oligonucleotide"
ugaguggaaacccgcuuuauu

SEQ ID NO: 1854 - RNA, 21 nt, Artificial Sequence
  source: /note="Description of Artificial Sequence: Synthetic oligonucleotide"
ccuucuuuccgagaauuccuu

SEQ ID NO: 1855 - RNA, 21 nt, Artificial Sequence
  source: /note="Description of Artificial Sequence: Synthetic oligonucleotide"
cugugaguggaaacccgcuuu

SEQ ID NO: 1856 - RNA, 21 nt, Artificial Sequence
  source: /note="Description of Artificial Sequence: Synthetic oligonucleotide"
gacccacaaaucucucuagau

SEQ ID NO: 1857 - RNA, 21 nt, Artificial Sequence
  source: /note="Description of Artificial Sequence: Synthetic oligonucleotide"
gcugggaaacaucaaaggaau

SEQ ID NO: 1858 - RNA, 21 nt, Artificial Sequence
  source: /note="Description of Artificial Sequence: Synthetic oligonucleotide"
acaguuggaaggcucaaggag

SEQ ID NO: 1859 - RNA, 21 nt, Artificial Sequence
  source: /note="Description of Artificial Sequence: Synthetic oligonucleotide"
aaggaggaggaacgaguccga

SEQ ID NO: 1860 - RNA, 21 nt, Artificial Sequence
  source: /note="Description of Artificial Sequence: Synthetic oligonucleotide"
ucuccucuuuaucagaaaaga

SEQ ID NO: 1861 - RNA, 21 nt, Artificial Sequence
  source: /note="Description of Artificial Sequence: Synthetic oligonucleotide"
uccagcagucuccucuuuaua

SEQ ID NO: 1862 - RNA, 21 nt, Artificial Sequence
  source: /note="Description of Artificial Sequence: Synthetic oligonucleotide"
aaagaagaagaucaagaaacu

SEQ ID NO: 1863 - RNA, 21 nt, Artificial Sequence
  source: /note="Description of Artificial Sequence: Synthetic oligonucleotide"
aagaagaagaucaagaaacuu

SEQ ID NO: 1864 - RNA, 21 nt, Artificial Sequence
  source: /note="Description of Artificial Sequence: Synthetic oligonucleotide"
gaggucgaaaaucccuggcua

SEQ ID NO: 1865 - RNA, 21 nt, Artificial Sequence
  source: /note="Description of Artificial Sequence: Synthetic oligonucleotide"
cccuggcugggaaacaucaaa

SEQ ID NO: 1866 - RNA, 21 nt, Artificial Sequence
  source: /note="Description of Artificial Sequence: Synthetic oligonucleotide"
cuggcugggaaacaucaaaga

SEQ ID NO: 1867 - RNA, 21 nt, Artificial Sequence
  source: /note="Description of Artificial Sequence: Synthetic oligonucleotide"
uggcugggaaacaucaaagga

SEQ ID NO: 1868 - RNA, 21 nt, Artificial Sequence
  source: /note="Description of Artificial Sequence: Synthetic oligonucleotide"
ggcugggaaacaucaaaggaa

SEQ ID NO: 1869 - RNA, 21 nt, Artificial Sequence
  source: /note="Description of Artificial Sequence: Synthetic oligonucleotide"
ucaaaggaauucucggaaaga

SEQ ID NO: 1870 - RNA, 21 nt, Artificial Sequence
  source: /note="Description of Artificial Sequence: Synthetic oligonucleotide"
ugggaaacaucaaaggaauua

SEQ ID NO: 1871 - RNA, 21 nt, Artificial Sequence
  source: /note="Description of Artificial Sequence: Synthetic oligonucleotide"
ggaaacaucaaaggaauucua

SEQ ID NO: 1872 - RNA, 21 nt, Artificial Sequence
  source: /note="Description of Artificial Sequence: Synthetic oligonucleotide"
gaaacaucaaaggaauucuca

SEQ ID NO: 1873 - RNA, 21 nt, Artificial Sequence
  source: /note="Description of Artificial Sequence: Synthetic oligonucleotide"
aaacaucaaaggaauucucga

SEQ ID NO: 1874 - RNA, 21 nt, Artificial Sequence
  source: /note="Description of Artificial Sequence: Synthetic oligonucleotide"
caucaaaggaauucucggaaa

SEQ ID NO: 1875 - RNA, 21 nt, Artificial Sequence
  source: /note="Description of Artificial Sequence: Synthetic oligonucleotide"
aaaggaauucucggaaagaaa

SEQ ID NO: 1876 - RNA, 21 nt, Artificial Sequence
  source: /note="Description of Artificial Sequence: Synthetic oligonucleotide"
aaggaauucucggaaagaaga

SEQ ID NO: 1877 - RNA, 21 nt, Artificial Sequence
  source: /note="Description of Artificial Sequence: Synthetic oligonucleotide"
ggcccucgagaacaagaagaa

SEQ ID NO: 1878 - RNA, 21 nt, Artificial Sequence
  source: /note="Description of Artificial Sequence: Synthetic oligonucleotide"
gcccucgagaacaagaagaaa

SEQ ID NO: 1879 - RNA, 21 nt, Artificial Sequence
  source: /note="Description of Artificial Sequence: Synthetic oligonucleotide"
cccucgagaacaagaagaaga

SEQ ID NO: 1880 - RNA, 21 nt, Artificial Sequence
  source: /note="Description of Artificial Sequence: Synthetic oligonucleotide"
ggaaaggaaaagaagaguaga

SEQ ID NO: 1881 - RNA, 21 nt, Artificial Sequence
  source: /note="Description of Artificial Sequence: Synthetic oligonucleotide"
aaggaaaagaagaguagccga

SEQ ID NO: 1882 - RNA, 21 nt, Artificial Sequence
  source: /note="Description of Artificial Sequence: Synthetic oligonucleotide"
gggggugugaacccccucgaa

SEQ ID NO: 1883 - RNA, 21 nt, Artificial Sequence
  source: /note="Description of Artificial Sequence: Synthetic oligonucleotide"
gggugugaacccccucgaaga

SEQ ID NO: 1884 - RNA, 21 nt, Artificial Sequence
  source: /note="Description of Artificial Sequence: Synthetic oligonucleotide"
aguuucuugaucuucuucuuu

SEQ ID NO: 1885 - RNA, 21 nt, Artificial Sequence
  source: /note="Description of Artificial Sequence: Synthetic oligonucleotide"
ucuuuucugauaaagaggaga

SEQ ID NO: 1886 - RNA, 21 nt, Artificial Sequence
  source: /note="Description of Artificial Sequence: Synthetic oligonucleotide"
agugguaaagaguauuggaaa

SEQ ID NO: 1887 - RNA, 21 nt, Artificial Sequence
  source: /note="Description of Artificial Sequence: Synthetic oligonucleotide"
cucaaguuucuugaucuucuu

SEQ ID NO: 1888 - RNA, 21 nt, Artificial Sequence
  source: /note="Description of Artificial Sequence: Synthetic oligonucleotide"
aaggccaaaagagaauacaaa

SEQ ID NO: 1889 - RNA, 21 nt, Artificial Sequence
  source: /note="Description of Artificial Sequence: Synthetic oligonucleotide"
aggccaaaagagaauacaaga

SEQ ID NO: 1890 - RNA, 21 nt, Artificial Sequence
  source: /note="Description of Artificial Sequence: Synthetic oligonucleotide"
cgauagagaaucgagagaaaa

SEQ ID NO: 1891 - RNA, 21 nt, Artificial Sequence
  source: /note="Description of Artificial Sequence: Synthetic oligonucleotide"
gauagagaaucgagagaaaag

SEQ ID NO: 1892 - RNA, 21 nt, Artificial Sequence
  source: /note="Description of Artificial Sequence: Synthetic oligonucleotide"
acccacaaaucucucuagauu

SEQ ID NO: 1893 - RNA, 21 nt, Artificial Sequence
  source: /note="Description of Artificial Sequence: Synthetic oligonucleotide"
ggaugggaagaguauauccua

SEQ ID NO: 1894 - RNA, 21 nt, Artificial Sequence
  source: /note="Description of Artificial Sequence: Synthetic oligonucleotide"
ccgauagagaaucgagagaaa

SEQ ID NO: 1895 - RNA, 21 nt, Artificial Sequence
  source: /note="Description of Artificial Sequence: Synthetic oligonucleotide"
uccgauagagaaucgagagaa

SEQ ID NO: 1896 - RNA, 21 nt, Artificial Sequence
  source: /note="Description of Artificial Sequence: Synthetic oligonucleotide"
ugaguggaaacccgcuuuauu

SEQ ID NO: 1897 - RNA, 21 nt, Artificial Sequence
  source: /note="Description of Artificial Sequence: Synthetic oligonucleotide"
ccuucuuuccgagaauuccuu

SEQ ID NO: 1898 - RNA, 21 nt, Artificial Sequence
  source: /note="Description of Artificial Sequence: Synthetic oligonucleotide"
cugugaguggaaacccgcuuu

SEQ ID NO: 1899 - RNA, 21 nt, Artificial Sequence
  source: /note="Description of Artificial Sequence: Synthetic oligonucleotide"
gacccacaaaucucucuagau

SEQ ID NO: 1900 - RNA, 21 nt, Artificial Sequence
  source: /note="Description of Artificial Sequence: Synthetic oligonucleotide"
gcugggaaacaucaaaggaau

SEQ ID NO: 1901 - RNA, 21 nt, Artificial Sequence
  source: /note="Description of Artificial Sequence: Synthetic oligonucleotide"
acaguuggaaggcucaaggag

SEQ ID NO: 1902 - RNA, 21 nt, Artificial Sequence
  source: /note="Description of Artificial Sequence: Synthetic oligonucleotide"
aaggaggaggaacgaguccga

SEQ ID NO: 1903 - RNA, 21 nt, Artificial Sequence
  source: /note="Description of Artificial Sequence: Synthetic oligonucleotide"
ucuccucuuuaucagaaaaga

SEQ ID NO: 1904 - RNA, 21 nt, Artificial Sequence
  source: /note="Description of Artificial Sequence: Synthetic oligonucleotide"
uccagcagucuccucuuuaua

SEQ ID NO: 1905 - RNA, 21 nt, Artificial Sequence
  source: /note="Description of Artificial Sequence: Synthetic oligonucleotide"
aaagaagaagaucaagaaacu

SEQ ID NO: 1906 - RNA, 21 nt, Artificial Sequence
  source: /note="Description of Artificial Sequence: Synthetic oligonucleotide"
aagaagaagaucaagaaacuu

SEQ ID NO: 1907 - RNA, 21 nt, Artificial Sequence
  source: /note="Description of Artificial Sequence: Synthetic oligonucleotide"
gaggucgaaaaucccuggcua

SEQ ID NO: 1908 - RNA, 21 nt, Artificial Sequence
  source: /note="Description of Artificial Sequence: Synthetic oligonucleotide"
cccuggcugggaaacaucaaa

SEQ ID NO: 1909 - RNA, 21 nt, Artificial Sequence
  source: /note="Description of Artificial Sequence: Synthetic oligonucleotide"
cuggcugggaaacaucaaaga

SEQ ID NO: 1910 - RNA, 21 nt, Artificial Sequence
  source: /note="Description of Artificial Sequence: Synthetic oligonucleotide"
uggcugggaaacaucaaagga

SEQ ID NO: 1911 - RNA, 21 nt, Artificial Sequence
  source: /note="Description of Artificial Sequence: Synthetic oligonucleotide"
ggcugggaaacaucaaaggaa

SEQ ID NO: 1912 - RNA, 21 nt, Artificial Sequence
  source: /note="Description of Artificial Sequence: Synthetic oligonucleotide"
ucaaaggaauucucggaaaga

SEQ ID NO: 1913 - RNA, 21 nt, Artificial Sequence
  source: /note="Description of Artificial Sequence: Synthetic oligonucleotide"
ugggaaacaucaaaggaauua

SEQ ID NO: 1914 - RNA, 21 nt, Artificial Sequence
  source: /note="Description of Artificial Sequence: Synthetic oligonucleotide"
ggaaacaucaaaggaauucua

SEQ ID NO: 1915 - RNA, 21 nt, Artificial Sequence
  source: /note="Description of Artificial Sequence: Synthetic oligonucleotide"
gaaacaucaaaggaauucuca

SEQ ID NO: 1916 - RNA, 21 nt, Artificial Sequence
  source: /note="Description of Artificial Sequence: Synthetic oligonucleotide"
caucaaaggaauucucggaaa

SEQ ID NO: 1917 - RNA, 21 nt, Artificial Sequence
  source: /note="Description of Artificial Sequence: Synthetic oligonucleotide"
aaaggaauucucggaaagaaa

SEQ ID NO: 1918 - RNA, 21 nt, Artificial Sequence
  source: /note="Description of Artificial Sequence: Synthetic oligonucleotide"
aaggaauucucggaaagaaga

SEQ ID NO: 1919 - RNA, 21 nt, Artificial Sequence
  source: /note="Description of Artificial Sequence: Synthetic oligonucleotide"
acgaaggaaggcccucgagaa

SEQ ID NO: 1920 - RNA, 21 nt, Artificial Sequence
  source: /note="Description of Artificial Sequence: Synthetic oligonucleotide"
ggcccucgagaacaagaagaa

SEQ ID NO: 1921 - RNA, 21 nt, Artificial Sequence
  source: /note="Description of Artificial Sequence: Synthetic oligonucleotide"
gcccucgagaacaagaagaaa

SEQ ID NO: 1922 - RNA, 21 nt, Artificial Sequence
  source: /note="Description of Artificial Sequence: Synthetic oligonucleotide"
cccucgagaacaagaagaaga

SEQ ID NO: 1923 - RNA, 21 nt, Artificial Sequence
  source: /note="Description of Artificial Sequence: Synthetic oligonucleotide"
ggaaaggaaaagaagaguaga

SEQ ID NO: 1924 - RNA, 21 nt, Artificial Sequence
  source: /note="Description of Artificial Sequence: Synthetic oligonucleotide"
aaggaaaagaagaguagccga

SEQ ID NO: 1925 - RNA, 21 nt, Artificial Sequence
  source: /note="Description of Artificial Sequence: Synthetic oligonucleotide"
gggggugugaacccccucgaa

SEQ ID NO: 1926 - RNA, 21 nt, Artificial Sequence
  source: /note="Description of Artificial Sequence: Synthetic oligonucleotide"
gggugugaacccccucgaaga

SEQ ID NO: 1927 - RNA, 19 nt, Artificial Sequence
  source: /note="Description of Artificial Sequence: Synthetic oligonucleotide"
aaacuugaggucgaaaaua

SEQ ID NO: 1928 - RNA, 19 nt, Artificial Sequence
  source: /note="Description of Artificial Sequence: Synthetic oligonucleotide"
aaacuugaggucgaaaaua

SEQ ID NO: 1929 - RNA, 19 nt, Artificial Sequence
  source: /note="Description of Artificial Sequence: Synthetic oligonucleotide"
aaacuugaggucgaaaaua

SEQ ID NO: 1930 - RNA, 19 nt, Artificial Sequence
  source: /note="Description of Artificial Sequence: Synthetic oligonucleotide"
aaacuugaggucgaaaaua

SEQ ID NO: 1931 - RNA, 21 nt, Artificial Sequence
  source: /note="Description of Artificial Sequence: Synthetic oligonucleotide"
agaaacuugaggucgaaaaua

SEQ ID NO: 1932 - RNA, 19 nt, Artificial Sequence
  source: /note="Description of Artificial Sequence: Synthetic oligonucleotide"
gaucaagaaacuugaggua

SEQ ID NO: 1933 - RNA, 19 nt, Artificial Sequence
  source: /note="Description of Artificial Sequence: Synthetic oligonucleotide"
gaucaagaaacuugaggua

SEQ ID NO: 1934 - RNA, 19 nt, Artificial Sequence
  source: /note="Description of Artificial Sequence: Synthetic oligonucleotide"
gaucaagaaacuugaggua

SEQ ID NO: 1935 - RNA, 21 nt, Artificial Sequence
  source: /note="Description of Artificial Sequence: Synthetic oligonucleotide"
aagaucaagaaacuugaggua

SEQ ID NO: 1936 - RNA, 19 nt, Artificial Sequence
  source: /note="Description of Artificial Sequence: Synthetic oligonucleotide"
ucaagaaacuugaggucga

SEQ ID NO: 1937 - RNA, 19 nt, Artificial Sequence
  source: /note="Description of Artificial Sequence: Synthetic oligonucleotide"
ucaagaaacuugaggucga

SEQ ID NO: 1938 - RNA, 19 nt, Artificial Sequence
  source: /note="Description of Artificial Sequence: Synthetic oligonucleotide"
ucaagaaacuugaggucga

SEQ ID NO: 1939 - RNA, 19 nt, Artificial Sequence
  source: /note="Description of Artificial Sequence: Synthetic oligonucleotide"
ucaagaaacuugaggucga

SEQ ID NO: 1940 - RNA, 19 nt, Artificial Sequence
  source: /note="Description of Artificial Sequence: Synthetic oligonucleotide"
ucaagaaacuugagcucga

SEQ ID NO: 1941 - RNA, 19 nt, Artificial Sequence
  source: /note="Description of Artificial Sequence: Synthetic oligonucleotide"
ucaagaaacuugaggucga

SEQ ID NO: 1942 - RNA, 19 nt, Artificial Sequence
  source: /note="Description of Artificial Sequence: Synthetic oligonucleotide"
aagaucaagaaacuugaga

SEQ ID NO: 1943 - RNA, 19 nt, Artificial Sequence
  source: /note="Description of Artificial Sequence: Synthetic oligonucleotide"
aagaucaagaaacuugaga

SEQ ID NO: 1944 - RNA, 19 nt, Artificial Sequence
  source: /note="Description of Artificial Sequence: Synthetic oligonucleotide"
aagaucaagaaacuugaga

SEQ ID NO: 1945 - RNA, 19 nt, Artificial Sequence
  source: /note="Description of Artificial Sequence: Synthetic oligonucleotide"
aagaucaagaaacuugaga

SEQ ID NO: 1946 - RNA, 19 nt, Artificial Sequence
  source: /note="Description of Artificial Sequence: Synthetic oligonucleotide"
aagaucaagaaacuagaga

SEQ ID NO: 1947 - RNA, 21 nt, Artificial Sequence
  source: /note="Description of Artificial Sequence: Synthetic oligonucleotide"
agaagaucaagaaacuugaga

SEQ ID NO: 1948 - RNA, 19 nt, Artificial Sequence
  source: /note="Description of Artificial Sequence: Synthetic oligonucleotide"
caucaaaggaauucucgga

SEQ ID NO: 1949 - RNA, 19 nt, Artificial Sequence
  source: /note="Description of Artificial Sequence: Synthetic oligonucleotide"
caucaaaggaauucucgga

SEQ ID NO: 1950 - RNA, 19 nt, Artificial Sequence
  source: /note="Description of Artificial Sequence: Synthetic oligonucleotide"
caucaaaggaauucucgga

SEQ ID NO: 1951 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
caucaaaggaauuctcgga

SEQ ID NO: 1952 - RNA, 21 nt, Artificial Sequence
  source: /note="Description of Artificial Sequence: Synthetic oligonucleotide"
aacaucaaaggaauucucgga

SEQ ID NO: 1953 - RNA, 19 nt, Artificial Sequence
  source: /note="Description of Artificial Sequence: Synthetic oligonucleotide"
aucaagaaacuugagguca

SEQ ID NO: 1954 - RNA, 19 nt, Artificial Sequence
  source: /note="Description of Artificial Sequence: Synthetic oligonucleotide"
aucaagaaacuugagguca

SEQ ID NO: 1955 - RNA, 19 nt, Artificial Sequence
  source: /note="Description of Artificial Sequence: Synthetic oligonucleotide"
aucaagaaacuugagguca

SEQ ID NO: 1956 - RNA, 19 nt, Artificial Sequence
  source: /note="Description of Artificial Sequence: Synthetic oligonucleotide"
aucaagaaacuugagguca

SEQ ID NO: 1957 - RNA, 19 nt, Artificial Sequence
  source: /note="Description of Artificial Sequence: Synthetic oligonucleotide"
aucaagaaacuugacguca

SEQ ID NO: 1958 - RNA, 21 nt, Artificial Sequence
  source: /note="Description of Artificial Sequence: Synthetic oligonucleotide"
agaucaagaaacuugagguca

SEQ ID NO: 1959 - RNA, 19 nt, Artificial Sequence
  source: /note="Description of Artificial Sequence: Synthetic oligonucleotide"
gaagaucaagaaacuugaa

SEQ ID NO: 1960 - RNA, 19 nt, Artificial Sequence
  source: /note="Description of Artificial Sequence: Synthetic oligonucleotide"
gaagaucaagaaacuugaa

SEQ ID NO: 1961 - RNA, 19 nt, Artificial Sequence
  source: /note="Description of Artificial Sequence: Synthetic oligonucleotide"
gaagaucaagaaacuugaa

SEQ ID NO: 1962 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
gaagaucaagaaactugaa

SEQ ID NO: 1963 - RNA, 21 nt, Artificial Sequence
  source: /note="Description of Artificial Sequence: Synthetic oligonucleotide"
aagaagaucaagaaacuugaa

SEQ ID NO: 1964 - RNA, 19 nt, Artificial Sequence
  source: /note="Description of Artificial Sequence: Synthetic oligonucleotide"
caaaggaauucucggaaag

SEQ ID NO: 1965 - RNA, 19 nt, Artificial Sequence
  source: /note="Description of Artificial Sequence: Synthetic oligonucleotide"
caaaggaauucucggaaag

SEQ ID NO: 1966 - RNA, 19 nt, Artificial Sequence
  source: /note="Description of Artificial Sequence: Synthetic oligonucleotide"
caaaggaauucucggaaag

SEQ ID NO: 1967 - RNA, 19 nt, Artificial Sequence
  source: /note="Description of Artificial Sequence: Synthetic oligonucleotide"
caaaggaauucucggaaag

SEQ ID NO: 1968 - RNA, 19 nt, Artificial Sequence
  source: /note="Description of Artificial Sequence: Synthetic oligonucleotide"
caaaggaauucucgcaaag

SEQ ID NO: 1969 - RNA, 21 nt, Artificial Sequence
  source: /note="Description of Artificial Sequence: Synthetic oligonucleotide"
aucaaaggaauucucggaaag

SEQ ID NO: 1970 - RNA, 19 nt, Artificial Sequence
  source: /note="Description of Artificial Sequence: Synthetic oligonucleotide"
caagaaacuugaggucgaa

SEQ ID NO: 1971 - RNA, 19 nt, Artificial Sequence
  source: /note="Description of Artificial Sequence: Synthetic oligonucleotide"
caagaaacuugaggucgaa

SEQ ID NO: 1972 - RNA, 19 nt, Artificial Sequence
  source: /note="Description of Artificial Sequence: Synthetic oligonucleotide"
caagaaacuugaggucgaa

SEQ ID NO: 1973 - RNA, 19 nt, Artificial Sequence
  source: /note="Description of Artificial Sequence: Synthetic oligonucleotide"
caagaaacuugaggucgaa

SEQ ID NO: 1974 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
caagaaacuugaggtcgaa

SEQ ID NO: 1975 - RNA, 21 nt, Artificial Sequence
  source: /note="Description of Artificial Sequence: Synthetic oligonucleotide"
aucaagaaacuugaggucgaa

SEQ ID NO: 1976 - RNA, 19 nt, Artificial Sequence
  source: /note="Description of Artificial Sequence: Synthetic oligonucleotide"
gaagaagaucaagaaacuu

SEQ ID NO: 1977 - RNA, 19 nt, Artificial Sequence
  source: /note="Description of Artificial Sequence: Synthetic oligonucleotide"
gaagaagaucaagaaacuu

SEQ ID NO: 1978 - RNA, 19 nt, Artificial Sequence
  source: /note="Description of Artificial Sequence: Synthetic oligonucleotide"
gaagaagaucaagaaacuu

SEQ ID NO: 1979 - RNA, 19 nt, Artificial Sequence
  source: /note="Description of Artificial Sequence: Synthetic oligonucleotide"
gaagaagaucaagaaacuu

SEQ ID NO: 1980 - RNA, 19 nt, Artificial Sequence
  source: /note="Description of Artificial Sequence: Synthetic oligonucleotide"
gaagaagaucaagaaacuu

SEQ ID NO: 1981 - RNA, 21 nt, Artificial Sequence
  source: /note="Description of Artificial Sequence: Synthetic oligonucleotide"
aagaagaagaucaagaaacuu

SEQ ID NO: 1982 - RNA, 19 nt, Artificial Sequence
  source: /note="Description of Artificial Sequence: Synthetic oligonucleotide"
ggaaacaucaaaggaauua

SEQ ID NO: 1983 - RNA, 19 nt, Artificial Sequence
  source: /note="Description of Artificial Sequence: Synthetic oligonucleotide"
ggaaacaucaaaggaauua

SEQ ID NO: 1984 - RNA, 19 nt, Artificial Sequence
  source: /note="Description of Artificial Sequence: Synthetic oligonucleotide"
ggaaacaucaaaggaauua

SEQ ID NO: 1985 - RNA, 19 nt, Artificial Sequence
  source: /note="Description of Artificial Sequence: Synthetic oligonucleotide"
ggaaacaucaaaggaauua

SEQ ID NO: 1986 - RNA, 19 nt, Artificial Sequence
  source: /note="Description of Artificial Sequence: Synthetic oligonucleotide"
ggaaacaucaaaggaauua

SEQ ID NO: 1987 - RNA, 21 nt, Artificial Sequence
  source: /note="Description of Artificial Sequence: Synthetic oligonucleotide"
ugggaaacaucaaaggaauua

SEQ ID NO: 1988 - RNA, 21 nt, Artificial Sequence
  source: /note="Description of Artificial Sequence: Synthetic oligonucleotide"
aaagaagaagaucaagaaacu

SEQ ID NO: 1989 - RNA, 21 nt, Artificial Sequence
  source: /note="Description of Artificial Sequence: Synthetic oligonucleotide"
aaagaagaagaucaagaaacu

SEQ ID NO: 1990 - RNA, 21 nt, Artificial Sequence
  source: /note="Description of Artificial Sequence: Synthetic oligonucleotide"
aaagaagaagaucaagaaacu

SEQ ID NO: 1991 - RNA, 21 nt, Artificial Sequence
  source: /note="Description of Artificial Sequence: Synthetic oligonucleotide"
aaagaagaagaucaagaaacu

SEQ ID NO: 1992 - RNA, 21 nt, Artificial Sequence
  source: /note="Description of Artificial Sequence: Synthetic oligonucleotide"
aaagaagaagaucaagaaacu

SEQ ID NO: 1993 - RNA, 19 nt, Artificial Sequence
  source: /note="Description of Artificial Sequence: Synthetic oligonucleotide"
agaagaagaucaagaaacu

SEQ ID NO: 1994 - RNA, 19 nt, Artificial Sequence
  source: /note="Description of Artificial Sequence: Synthetic oligonucleotide"
agaagaagaucaagaaacu

SEQ ID NO: 1995 - RNA, 19 nt, Artificial Sequence
  source: /note="Description of Artificial Sequence: Synthetic oligonucleotide"
agaagaagaucaagaaacu

SEQ ID NO: 1996 - RNA, 19 nt, Artificial Sequence
  source: /note="Description of Artificial Sequence: Synthetic oligonucleotide"
agaagaagaucaagaaacu

SEQ ID NO: 1997 - RNA, 19 nt, Artificial Sequence
  source: /note="Description of Artificial Sequence: Synthetic oligonucleotide"
agaagaagaucaagaaacu

SEQ ID NO: 1998 - RNA, 19 nt, Artificial Sequence
  source: /note="Description of Artificial Sequence: Synthetic oligonucleotide"
agaagaagaucaagaaacu

SEQ ID NO: 1999 - RNA, 19 nt, Artificial Sequence
  source: /note="Description of Artificial Sequence: Synthetic oligonucleotide"
aacaucaaaggaauucuca

SEQ ID NO: 2000 - RNA, 19 nt, Artificial Sequence
  source: /note="Description of Artificial Sequence: Synthetic oligonucleotide"
aacaucaaaggaauucuca

SEQ ID NO: 2001 - RNA, 19 nt, Artificial Sequence
  source: /note="Description of Artificial Sequence: Synthetic oligonucleotide"
aacaucaaaggaauucuca

SEQ ID NO: 2002 - RNA, 19 nt, Artificial Sequence
  source: /note="Description of Artificial Sequence: Synthetic oligonucleotide"
aacaucaaaggaauucuca

SEQ ID NO: 2003 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
aacaucaaaggaautcuca

SEQ ID NO: 2004 - RNA, 19 nt, Artificial Sequence
  source: /note="Description of Artificial Sequence: Synthetic oligonucleotide"
aacaucaaaggaauucuca

SEQ ID NO: 2005 - RNA, 19 nt, Artificial Sequence
  source: /note="Description of Artificial Sequence: Synthetic oligonucleotide"
aggaauucucggaaagaaa

SEQ ID NO: 2006 - RNA, 19 nt, Artificial Sequence
  source: /note="Description of Artificial Sequence: Synthetic oligonucleotide"
aggaauucucggaaagaaa

SEQ ID NO: 2007 - RNA, 19 nt, Artificial Sequence
  source: /note="Description of Artificial Sequence: Synthetic oligonucleotide"
aggaauucucggaaagaaa

SEQ ID NO: 2008 - RNA, 19 nt, Artificial Sequence
  source: /note="Description of Artificial Sequence: Synthetic oligonucleotide"
aggaauucucggaaagaaa

SEQ ID NO: 2009 - RNA, 19 nt, Artificial Sequence
  source: /note="Description of Artificial Sequence: Synthetic oligonucleotide"
aggaauucucggaaagaaa

SEQ ID NO: 2010 - RNA, 21 nt, Artificial Sequence
  source: /note="Description of Artificial Sequence: Synthetic oligonucleotide"
aaaggaauucucggaaagaaa

SEQ ID NO: 2011 - RNA, 19 nt, Artificial Sequence
  source: /note="Description of Artificial Sequence: Synthetic oligonucleotide"
aaaggaauucucggaaaga

SEQ ID NO: 2012 - RNA, 19 nt, Artificial Sequence
  source: /note="Description of Artificial Sequence: Synthetic oligonucleotide"
aaaggaauucucggaaaga

SEQ ID NO: 2013 - RNA, 19 nt, Artificial Sequence
  source: /note="Description of Artificial Sequence: Synthetic oligonucleotide"
aaaggaauucucggaaaga

SEQ ID NO: 2014 - RNA, 19 nt, Artificial Sequence
  source: /note="Description of Artificial Sequence: Synthetic oligonucleotide"
aaaggaauucucggaaaga

SEQ ID NO: 2015 - RNA, 19 nt, Artificial Sequence
  source: /note="Description of Artificial Sequence: Synthetic oligonucleotide"
aaaggaauucucggaaaga

SEQ ID NO: 2016 - RNA, 21 nt, Artificial Sequence
  source: /note="Description of Artificial Sequence: Synthetic oligonucleotide"
ucaaaggaauucucggaaaga

SEQ ID NO: 2017 - RNA, 23 nt, Artificial Sequence
  source: /note="Description of Artificial Sequence: Synthetic oligonucleotide"
ucucuuuuggccuucuugggaga

SEQ ID NO: 2018 - RNA, 23 nt, Artificial Sequence
  source: /note="Description of Artificial Sequence: Synthetic oligonucleotide"
aaagaagaagaucaagaaacuug

SEQ ID NO: 2019 - RNA, 23 nt, Artificial Sequence
  source: /note="Description of Artificial Sequence: Synthetic oligonucleotide"
ucuccucuuuaucagaaaagagu

SEQ ID NO: 2020 - RNA, 23 nt, Artificial Sequence
  source: /note="Description of Artificial Sequence: Synthetic oligonucleotide"
uuuccaauacucuuuaccacuuu

SEQ ID NO: 2021 - RNA, 23 nt, Artificial Sequence
  source: /note="Description of Artificial Sequence: Synthetic oligonucleotide"
aagaagaucaagaaacuugaggu

SEQ ID NO: 2022 - RNA, 23 nt, Artificial Sequence
  source: /note="Description of Artificial Sequence: Synthetic oligonucleotide"
uuuguauucucuuuuggccuucu

SEQ ID NO: 2023 - RNA, 23 nt, Artificial Sequence
  source: /note="Description of Artificial Sequence: Synthetic oligonucleotide"
aagaucaagaaacuugaggucga

SEQ ID NO: 2024 - RNA, 23 nt, Artificial Sequence
  source: /note="Description of Artificial Sequence: Synthetic oligonucleotide"
ucuuguauucucuuuuggccuuc

SEQ ID NO: 2025 - RNA, 23 nt, Artificial Sequence
  source: /note="Description of Artificial Sequence: Synthetic oligonucleotide"
uuuucucucgauucucuaucgga

SEQ ID NO: 2026 - RNA, 23 nt, Artificial Sequence
  source: /note="Description of Artificial Sequence: Synthetic oligonucleotide"
cuuuucucucgauucucuaucgg

SEQ ID NO: 2027 - RNA, 23 nt, Artificial Sequence
  source: /note="Description of Artificial Sequence: Synthetic oligonucleotide"
aaucuagagagauuugugggucc

SEQ ID NO: 2028 - RNA, 23 nt, Artificial Sequence
  source: /note="Description of Artificial Sequence: Synthetic oligonucleotide"
uaggauauacucuucccauccga

SEQ ID NO: 2029 - RNA, 23 nt, Artificial Sequence
  source: /note="Description of Artificial Sequence: Synthetic oligonucleotide"
uuucucucgauucucuaucggaa

SEQ ID NO: 2030 - RNA, 23 nt, Artificial Sequence
  source: /note="Description of Artificial Sequence: Synthetic oligonucleotide"
uucucucgauucucuaucggaau

SEQ ID NO: 2031 - RNA, 23 nt, Artificial Sequence
  source: /note="Description of Artificial Sequence: Synthetic oligonucleotide"
aauaaagcggguuuccacucaca

SEQ ID NO: 2032 - RNA, 23 nt, Artificial Sequence
  source: /note="Description of Artificial Sequence: Synthetic oligonucleotide"
aaggaauucucggaaagaaggac

SEQ ID NO: 2033 - RNA, 23 nt, Artificial Sequence
  source: /note="Description of Artificial Sequence: Synthetic oligonucleotide"
aaagcggguuuccacucacaggu

SEQ ID NO: 2034 - RNA, 23 nt, Artificial Sequence
  source: /note="Description of Artificial Sequence: Synthetic oligonucleotide"
aucuagagagauuuguggguccc

SEQ ID NO: 2035 - RNA, 23 nt, Artificial Sequence
  source: /note="Description of Artificial Sequence: Synthetic oligonucleotide"
auuccuuugauguuucccagcca

SEQ ID NO: 2036 - RNA, 23 nt, Artificial Sequence
  source: /note="Description of Artificial Sequence: Synthetic oligonucleotide"
ugucaaccuuccgaguuccucuu

SEQ ID NO: 2037 - RNA, 23 nt, Artificial Sequence
  source: /note="Description of Artificial Sequence: Synthetic oligonucleotide"
uuccuccuccuugcucaggcucu

SEQ ID NO: 2038 - RNA, 23 nt, Artificial Sequence
  source: /note="Description of Artificial Sequence: Synthetic oligonucleotide"
ucuuuucugauaaagaggagacu

SEQ ID NO: 2039 - RNA, 23 nt, Artificial Sequence
  source: /note="Description of Artificial Sequence: Synthetic oligonucleotide"
uauaaagaggagacugcuggacu

SEQ ID NO: 2040 - RNA, 23 nt, Artificial Sequence
  source: /note="Description of Artificial Sequence: Synthetic oligonucleotide"
aguuucuugaucuucuucuuugu

SEQ ID NO: 2041 - RNA, 23 nt, Artificial Sequence
  source: /note="Description of Artificial Sequence: Synthetic oligonucleotide"
aaguuucuugaucuucuucuuug

SEQ ID NO: 2042 - RNA, 23 nt, Artificial Sequence
  source: /note="Description of Artificial Sequence: Synthetic oligonucleotide"
uagccagggauuuucgaccucaa

SEQ ID NO: 2043 - RNA, 23 nt, Artificial Sequence
  source: /note="Description of Artificial Sequence: Synthetic oligonucleotide"
uuugauguuucccagccagggau

SEQ ID NO: 2044 - RNA, 23 nt, Artificial Sequence
  source: /note="Description of Artificial Sequence: Synthetic oligonucleotide"
ucuuugauguuucccagccaggg

SEQ ID NO: 2045 - RNA, 23 nt, Artificial Sequence
  source: /note="Description of Artificial Sequence: Synthetic oligonucleotide"
uccuuugauguuucccagccagg

SEQ ID NO: 2046 - RNA, 23 nt, Artificial Sequence
  source: /note="Description of Artificial Sequence: Synthetic oligonucleotide"
uuccuuugauguuucccagccag

SEQ ID NO: 2047 - RNA, 23 nt, Artificial Sequence
  source: /note="Description of Artificial Sequence: Synthetic oligonucleotide"
ucuuuccgagaauuccuuugaug

SEQ ID NO: 2048 - RNA, 23 nt, Artificial Sequence
  source: /note="Description of Artificial Sequence: Synthetic oligonucleotide"
uaauuccuuugauguuucccagc

SEQ ID NO: 2049 - RNA, 23 nt, Artificial Sequence
  source: /note="Description of Artificial Sequence: Synthetic oligonucleotide"
uagaauuccuuugauguuuccca

SEQ ID NO: 2050 - RNA, 23 nt, Artificial Sequence
  source: /note="Description of Artificial Sequence: Synthetic oligonucleotide"
ugagaauuccuuugauguuuccc

SEQ ID NO: 2051 - RNA, 23 nt, Artificial Sequence
  source: /note="Description of Artificial Sequence: Synthetic oligonucleotide"
ucgagaauuccuuugauguuucc

SEQ ID NO: 2052 - RNA, 23 nt, Artificial Sequence
  source: /note="Description of Artificial Sequence: Synthetic oligonucleotide"
uuuccgagaauuccuuugauguu

SEQ ID NO: 2053 - RNA, 23 nt, Artificial Sequence
  source: /note="Description of Artificial Sequence: Synthetic oligonucleotide"
uuucuuuccgagaauuccuuuga

SEQ ID NO: 2054 - RNA, 23 nt, Artificial Sequence
  source: /note="Description of Artificial Sequence: Synthetic oligonucleotide"
ucuucuuuccgagaauuccuuug

SEQ ID NO: 2055 - RNA, 23 nt, Artificial Sequence
  source: /note="Description of Artificial Sequence: Synthetic oligonucleotide"
uucuucuuguucucgagggccuu

SEQ ID NO: 2056 - RNA, 23 nt, Artificial Sequence
  source: /note="Description of Artificial Sequence: Synthetic oligonucleotide"
uuucuucuuguucucgagggccu

SEQ ID NO: 2057 - RNA, 23 nt, Artificial Sequence
  source: /note="Description of Artificial Sequence: Synthetic oligonucleotide"
ucuucuucuuguucucgagggcc

SEQ ID NO: 2058 - RNA, 23 nt, Artificial Sequence
  source: /note="Description of Artificial Sequence: Synthetic oligonucleotide"
ucuacucuucuuuuccuuuccuc

SEQ ID NO: 2059 - RNA, 23 nt, Artificial Sequence
  source: /note="Description of Artificial Sequence: Synthetic oligonucleotide"
ucggcuacucuucuuuuccuuuc

SEQ ID NO: 2060 - RNA, 23 nt, Artificial Sequence
  source: /note="Description of Artificial Sequence: Synthetic oligonucleotide"
uucgaggggguucacacccccaa

SEQ ID NO: 2061 - RNA, 23 nt, Artificial Sequence
  source: /note="Description of Artificial Sequence: Synthetic oligonucleotide"
ucuucgaggggguucacaccccc

SEQ ID NO: 2062 - RNA, 23 nt, Artificial Sequence
  source: /note="Description of Artificial Sequence: Synthetic oligonucleotide"
aaagaagaagaucaagaaacuug

SEQ ID NO: 2063 - RNA, 23 nt, Artificial Sequence
  source: /note="Description of Artificial Sequence: Synthetic oligonucleotide"
ucuccucuuuaucagaaaagagu

SEQ ID NO: 2064 - RNA, 23 nt, Artificial Sequence
  source: /note="Description of Artificial Sequence: Synthetic oligonucleotide"
uuuccaauacucuuuaccacuuu

SEQ ID NO: 2065 - RNA, 23 nt, Artificial Sequence
  source: /note="Description of Artificial Sequence: Synthetic oligonucleotide"
aagaagaucaagaaacuugaggu

SEQ ID NO: 2066 - RNA, 23 nt, Artificial Sequence
  source: /note="Description of Artificial Sequence: Synthetic oligonucleotide"
uuuguauucucuuuuggccuucu

SEQ ID NO: 2067 - RNA, 23 nt, Artificial Sequence
  source: /note="Description of Artificial Sequence: Synthetic oligonucleotide"
ucuuguauucucuuuuggccuuc

SEQ ID NO: 2068 - RNA, 23 nt, Artificial Sequence
  source: /note="Description of Artificial Sequence: Synthetic oligonucleotide"
uuuucucucgauucucuaucgga

SEQ ID NO: 2069 - RNA, 23 nt, Artificial Sequence
  source: /note="Description of Artificial Sequence: Synthetic oligonucleotide"
cuuuucucucgauucucuaucgg

SEQ ID NO: 2070 - RNA, 23 nt, Artificial Sequence
  source: /note="Description of Artificial Sequence: Synthetic oligonucleotide"
aaucuagagagauuugugggucc

SEQ ID NO: 2071 - RNA, 23 nt, Artificial Sequence
  source: /note="Description of Artificial Sequence: Synthetic oligonucleotide"
uaggauauacucuucccauccga

SEQ ID NO: 2072 - RNA, 23 nt, Artificial Sequence
  source: /note="Description of Artificial Sequence: Synthetic oligonucleotide"
uuucucucgauucucuaucggaa

SEQ ID NO: 2073 - RNA, 23 nt, Artificial Sequence
  source: /note="Description of Artificial Sequence: Synthetic oligonucleotide"
uucucucgauucucuaucggaau

SEQ ID NO: 2074 - RNA, 23 nt, Artificial Sequence
  source: /note="Description of Artificial Sequence: Synthetic oligonucleotide"
aauaaagcggguuuccacucaca

SEQ ID NO: 2075 - RNA, 23 nt, Artificial Sequence
  source: /note="Description of Artificial Sequence: Synthetic oligonucleotide"
aaggaauucucggaaagaaggac

SEQ ID NO: 2076 - RNA, 23 nt, Artificial Sequence
  source: /note="Description of Artificial Sequence: Synthetic oligonucleotide"
aaagcggguuuccacucacaggu

SEQ ID NO: 2077 - RNA, 23 nt, Artificial Sequence
  source: /note="Description of Artificial Sequence: Synthetic oligonucleotide"
aucuagagagauuuguggguccc

SEQ ID NO: 2078 - RNA, 23 nt, Artificial Sequence
  source: /note="Description of Artificial Sequence: Synthetic oligonucleotide"
auuccuuugauguuucccagcca

SEQ ID NO: 2079 - RNA, 23 nt, Artificial Sequence
  source: /note="Description of Artificial Sequence: Synthetic oligonucleotide"
ugucaaccuuccgaguuccucuu

SEQ ID NO: 2080 - RNA, 23 nt, Artificial Sequence
  source: /note="Description of Artificial Sequence: Synthetic oligonucleotide"
uuccuccuccuugcucaggcucu

SEQ ID NO: 2081 - RNA, 23 nt, Artificial Sequence
  source: /note="Description of Artificial Sequence: Synthetic oligonucleotide"
ucuuuucugauaaagaggagacu

SEQ ID NO: 2082 - RNA, 23 nt, Artificial Sequence
  source: /note="Description of Artificial Sequence: Synthetic oligonucleotide"
uauaaagaggagacugcuggacu

SEQ ID NO: 2083 - RNA, 23 nt, Artificial Sequence
  source: /note="Description of Artificial Sequence: Synthetic oligonucleotide"
aguuucuugaucuucuucuuugu

SEQ ID NO: 2084 - RNA, 23 nt, Artificial Sequence
  source: /note="Description of Artificial Sequence: Synthetic oligonucleotide"
aaguuucuugaucuucuucuuug

SEQ ID NO: 2085 - RNA, 23 nt, Artificial Sequence
  source: /note="Description of Artificial Sequence: Synthetic oligonucleotide"
uagccagggauuuucgaccucaa

SEQ ID NO: 2086 - RNA, 23 nt, Artificial Sequence
  source: /note="Description of Artificial Sequence: Synthetic oligonucleotide"
uuugauguuucccagccagggau

SEQ ID NO: 2087 - RNA, 23 nt, Artificial Sequence
  source: /note="Description of Artificial Sequence: Synthetic oligonucleotide"
ucuuugauguuucccagccaggg

SEQ ID NO: 2088 - RNA, 23 nt, Artificial Sequence
  source: /note="Description of Artificial Sequence: Synthetic oligonucleotide"
uccuuugauguuucccagccagg

SEQ ID NO: 2089 - RNA, 23 nt, Artificial Sequence
  source: /note="Description of Artificial Sequence: Synthetic oligonucleotide"
uuccuuugauguuucccagccag

SEQ ID NO: 2090 - RNA, 23 nt, Artificial Sequence
  source: /note="Description of Artificial Sequence: Synthetic oligonucleotide"
ucuuuccgagaauuccuuugaug

SEQ ID NO: 2091 - RNA, 23 nt, Artificial Sequence
  source: /note="Description of Artificial Sequence: Synthetic oligonucleotide"
uaauuccuuugauguuucccagc

SEQ ID NO: 2092 - RNA, 23 nt, Artificial Sequence
  source: /note="Description of Artificial Sequence: Synthetic oligonucleotide"
uagaauuccuuugauguuuccca

SEQ ID NO: 2093 - RNA, 23 nt, Artificial Sequence
  source: /note="Description of Artificial Sequence: Synthetic oligonucleotide"
ugagaauuccuuugauguuuccc

SEQ ID NO: 2094 - RNA, 23 nt, Artificial Sequence
  source: /note="Description of Artificial Sequence: Synthetic oligonucleotide"
uuuccgagaauuccuuugauguu

SEQ ID NO: 2095 - RNA, 23 nt, Artificial Sequence
  source: /note="Description of Artificial Sequence: Synthetic oligonucleotide"
uuucuuuccgagaauuccuuuga

SEQ ID NO: 2096 - RNA, 23 nt, Artificial Sequence
  source: /note="Description of Artificial Sequence: Synthetic oligonucleotide"
ucuucuuuccgagaauuccuuug

SEQ ID NO: 2097 - RNA, 23 nt, Artificial Sequence
  source: /note="Description of Artificial Sequence: Synthetic oligonucleotide"
uucucgagggccuuccuucgucg

SEQ ID NO: 2098 - RNA, 23 nt, Artificial Sequence
  source: /note="Description of Artificial Sequence: Synthetic oligonucleotide"
uucuucuuguucucgagggccuu

SEQ ID NO: 2099 - RNA, 23 nt, Artificial Sequence
  source: /note="Description of Artificial Sequence: Synthetic oligonucleotide"
uuucuucuuguucucgagggccu

SEQ ID NO: 2100 - RNA, 23 nt, Artificial Sequence
  source: /note="Description of Artificial Sequence: Synthetic oligonucleotide"
ucuucuucuuguucucgagggcc

SEQ ID NO: 2101 - RNA, 23 nt, Artificial Sequence
  source: /note="Description of Artificial Sequence: Synthetic oligonucleotide"
ucuacucuucuuuuccuuuccuc

SEQ ID NO: 2102 - RNA, 23 nt, Artificial Sequence
  source: /note="Description of Artificial Sequence: Synthetic oligonucleotide"
ucggcuacucuucuuuuccuuuc

SEQ ID NO: 2103 - RNA, 23 nt, Artificial Sequence
  source: /note="Description of Artificial Sequence: Synthetic oligonucleotide"
uucgaggggguucacacccccaa

SEQ ID NO: 2104 - RNA, 23 nt, Artificial Sequence
  source: /note="Description of Artificial Sequence: Synthetic oligonucleotide"
ucuucgaggggguucacaccccc

SEQ ID NO: 2105 - RNA, 21 nt, Artificial Sequence
  source: /note="Description of Artificial Sequence: Synthetic oligonucleotide"
uauuuucgaccucaaguuuuu

SEQ ID NO: 2106 - RNA, 21 nt, Artificial Sequence
  source: /note="Description of Artificial Sequence: Synthetic oligonucleotide"
uauuuucgaccucaaguuuuu

SEQ ID NO: 2107 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuuucgacctcaaguuuuu

SEQ ID NO: 2108 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuuucgacctcaaguuuuu

SEQ ID NO: 2109 - RNA, 21 nt, Artificial Sequence
  source: /note="Description of Artificial Sequence: Synthetic oligonucleotide"
uauuuucgaccucaaguuucu

SEQ ID NO: 2110 - RNA, 21 nt, Artificial Sequence
  source: /note="Description of Artificial Sequence: Synthetic oligonucleotide"
uaccucaaguuucuugaucuu

SEQ ID NO: 2111 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccucaaguutcuugaucuu

SEQ ID NO: 2112 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccucaaguutcuugaucuu

SEQ ID NO: 2113 - RNA, 21 nt, Artificial Sequence
  source: /note="Description of Artificial Sequence: Synthetic oligonucleotide"
uaccucaaguuucuugaucuu

SEQ ID NO: 2114 - RNA, 21 nt, Artificial Sequence
  source: /note="Description of Artificial Sequence: Synthetic oligonucleotide"
ucgaccucaaguuucuugauu

SEQ ID NO: 2115 - RNA, 21 nt, Artificial Sequence
  source: /note="Description of Artificial Sequence: Synthetic oligonucleotide"
ucgaccucaaguuucuugauu

SEQ ID NO: 2116 - RNA, 21 nt, Artificial Sequence
  source: /note="Description of Artificial Sequence: Synthetic oligonucleotide"
ucgaccucaaguuucuugauu

SEQ ID NO: 2117 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaccucaagtuucuugauu

SEQ ID NO: 2118 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaccucaagtuucuugauu

SEQ ID NO: 2119 - RNA, 19 nt, Artificial Sequence
  source: /note="Description of Artificial Sequence: Synthetic oligonucleotide"
ucgaccucaaguuucuuga

SEQ ID NO: 2120 - RNA, 21 nt, Artificial Sequence
  source: /note="Description of Artificial Sequence: Synthetic oligonucleotide"
ucucaaguuucuugaucuuuu

SEQ ID NO: 2121 - RNA, 21 nt, Artificial Sequence
  source: /note="Description of Artificial Sequence: Synthetic oligonucleotide"
ucucaaguuucuugaucuuuu

SEQ ID NO: 2122 - RNA, 21 nt, Artificial Sequence
  source: /note="Description of Artificial Sequence: Synthetic oligonucleotide"
ucucaaguuucuugaucuuuu

SEQ ID NO: 2123 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucaaguuuctugaucuuuu

SEQ ID NO: 2124 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucaaguuuctugaucuuuu

SEQ ID NO: 2125 - RNA, 21 nt, Artificial Sequence
  source: /note="Description of Artificial Sequence: Synthetic oligonucleotide"
ucucaaguuucuugaucuucu

SEQ ID NO: 2126 - RNA, 21 nt, Artificial Sequence
  source: /note="Description of Artificial Sequence: Synthetic oligonucleotide"
uccgagaauuccuuugauguu

SEQ ID NO: 2127 - RNA, 21 nt, Artificial Sequence
  source: /note="Description of Artificial Sequence: Synthetic oligonucleotide"
uccgagaauuccuuugauguu

SEQ ID NO: 2128 - RNA, 21 nt, Artificial Sequence
  source: /note="Description of Artificial Sequence: Synthetic oligonucleotide"
uccgagaauuccuuugauguu

SEQ ID NO: 2129 - RNA, 21 nt, Artificial Sequence
  source: /note="Description of Artificial Sequence: Synthetic oligonucleotide"
uccgagaauuccuuugauguu

SEQ ID NO: 2130 - RNA, 21 nt, Artificial Sequence
  source: /note="Description of Artificial Sequence: Synthetic oligonucleotide"
uccgagaauuccuuugauguu

SEQ ID NO: 2131 - RNA, 21 nt, Artificial Sequence
  source: /note="Description of Artificial Sequence: Synthetic oligonucleotide"
ugaccucaaguuucuugauuu

SEQ ID NO: 2132 - RNA, 21 nt, Artificial Sequence
  source: /note="Description of Artificial Sequence: Synthetic oligonucleotide"
ugaccucaaguuucuugauuu

SEQ ID NO: 2133 - RNA, 21 nt, Artificial Sequence
  source: /note="Description of Artificial Sequence: Synthetic oligonucleotide"
ugaccucaaguuucuugauuu

SEQ ID NO: 2134 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaccucaagutucuugauuu

SEQ ID NO: 2135 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaccucaagutucuugauuu

SEQ ID NO: 2136 - RNA, 21 nt, Artificial Sequence
  source: /note="Description of Artificial Sequence: Synthetic oligonucleotide"
ugaccucaaguuucuugaucu

SEQ ID NO: 2137 - RNA, 21 nt, Artificial Sequence
  source: /note="Description of Artificial Sequence: Synthetic oligonucleotide"
uucaaguuucuugaucuucuu

SEQ ID NO: 2138 - RNA, 21 nt, Artificial Sequence
  source: /note="Description of Artificial Sequence: Synthetic oligonucleotide"
uucaaguuucuugaucuucuu

SEQ ID NO: 2139 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaaguuucutgaucuucuu

SEQ ID NO: 2140 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaaguuucutgaucuucuu

SEQ ID NO: 2141 - RNA, 21 nt, Artificial Sequence
  source: /note="Description of Artificial Sequence: Synthetic oligonucleotide"
uucaaguuucuugaucuucuu

SEQ ID NO: 2142 - RNA, 21 nt, Artificial Sequence
  source: /note="Description of Artificial Sequence: Synthetic oligonucleotide"
cuuuccgagaauuccuuugau

SEQ ID NO: 2143 - RNA, 21 nt, Artificial Sequence
  source: /note="Description of Artificial Sequence: Synthetic oligonucleotide"
cuuuccgagaauuccuuugau

SEQ ID NO: 2144 - RNA, 21 nt, Artificial Sequence
  source: /note="Description of Artificial Sequence: Synthetic oligonucleotide"
cuuuccgagaauuccuuugau

SEQ ID NO: 2145 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuccgagaatuccuuugau

SEQ ID NO: 2146 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuccgagaatuccuuugau

SEQ ID NO: 2147 - RNA, 21 nt, Artificial Sequence
  source: /note="Description of Artificial Sequence: Synthetic oligonucleotide"
cuuuccgagaauuccuuugau

SEQ ID NO: 2148 - RNA, 21 nt, Artificial Sequence
  source: /note="Description of Artificial Sequence: Synthetic oligonucleotide"
uucgaccucaaguuucuugau

SEQ ID NO: 2149 - RNA, 21 nt, Artificial Sequence
  source: /note="Description of Artificial Sequence: Synthetic oligonucleotide"
uucgaccucaaguuucuugau

SEQ ID NO: 2150 - RNA, 21 nt, Artificial Sequence
  source: /note="Description of Artificial Sequence: Synthetic oligonucleotide"
uucgaccucaaguuucuugau

SEQ ID NO: 2151 - RNA, 21 nt, Artificial Sequence
  source: /note="Description of Artificial Sequence: Synthetic oligonucleotide"
uucgaccucaaguuucuugau

SEQ ID NO: 2152 - RNA, 21 nt, Artificial Sequence
  source: /note="Description of Artificial Sequence: Synthetic oligonucleotide"
uucgaccucaaguuucuugau

SEQ ID NO: 2153 - RNA, 21 nt, Artificial Sequence
  source: /note="Description of Artificial Sequence: Synthetic oligonucleotide"
uucgaccucaaguuucuugau

SEQ ID NO: 2154 - RNA, 21 nt, Artificial Sequence
  source: /note="Description of Artificial Sequence: Synthetic oligonucleotide"
aaguuucuugaucuucuucuu

SEQ ID NO: 2155 - RNA, 21 nt, Artificial Sequence
  source: /note="Description of Artificial Sequence: Synthetic oligonucleotide"
aaguuucuugaucuucuucuu

SEQ ID NO: 2156 - RNA, 21 nt, Artificial Sequence
  source: /note="Description of Artificial Sequence: Synthetic oligonucleotide"
aaguuucuugaucuucuucuu

SEQ ID NO: 2157 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguuucuugatcuucuucuu

SEQ ID NO: 2158 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguuucuugatcuucuucuu

SEQ ID NO: 2159 - RNA, 21 nt, Artificial Sequence
  source: /note="Description of Artificial Sequence: Synthetic oligonucleotide"
aaguuucuugaucuucuucuu

SEQ ID NO: 2160 - RNA, 21 nt, Artificial Sequence
  source: /note="Description of Artificial Sequence: Synthetic oligonucleotide"
uaauuccuuugauguuuccuu

SEQ ID NO: 2161 - RNA, 21 nt, Artificial Sequence
  source: /note="Description of Artificial Sequence: Synthetic oligonucleotide"
uaauuccuuugauguuuccuu

SEQ ID NO: 2162 - RNA, 21 nt, Artificial Sequence
  source: /note="Description of Artificial Sequence: Synthetic oligonucleotide"
uaauuccuuugauguuuccuu

SEQ ID NO: 2163 - RNA, 20 nt, Artificial Sequence
  source: /note="Description of Artificial Sequence: Synthetic oligonucleotide"
uaauuccuuugauguuucuu

SEQ ID NO: 2164 - RNA, 21 nt, Artificial Sequence
  source: /note="Description of Artificial Sequence: Synthetic oligonucleotide"
uaauuccuuugauguuuccuu

SEQ ID NO: 2165 - RNA, 21 nt, Artificial Sequence
  source: /note="Description of Artificial Sequence: Synthetic oligonucleotide"
uaauuccuuugauguuuccca

SEQ ID NO: 2166 - RNA, 23 nt, Artificial Sequence
  source: /note="Description of Artificial Sequence: Synthetic oligonucleotide"
aguuucuugaucuucuucuuugu

SEQ ID NO: 2167 - RNA, 23 nt, Artificial Sequence
  source: /note="Description of Artificial Sequence: Synthetic oligonucleotide"
aguuucuugaucuucuucuuugu

SEQ ID NO: 2168 - RNA, 23 nt, Artificial Sequence
  source: /note="Description of Artificial Sequence: Synthetic oligonucleotide"
aguuucuugaucuucuucuuugu

SEQ ID NO: 2169 - RNA, 23 nt, Artificial Sequence
  source: /note="Description of Artificial Sequence: Synthetic oligonucleotide"
aguuucuugaucuucuucuuugu

SEQ ID NO: 2170 - RNA, 21 nt, Artificial Sequence
  source: /note="Description of Artificial Sequence: Synthetic oligonucleotide"
aguuucuugaucuucuucuuu

SEQ ID NO: 2171 - RNA, 21 nt, Artificial Sequence
  source: /note="Description of Artificial Sequence: Synthetic oligonucleotide"
aguuucuugaucuucuucuuu

SEQ ID NO: 2172 - RNA, 21 nt, Artificial Sequence
  source: /note="Description of Artificial Sequence: Synthetic oligonucleotide"
aguuucuugaucuucuucuuu

SEQ ID NO: 2173 - RNA, 21 nt, Artificial Sequence
  source: /note="Description of Artificial Sequence: Synthetic oligonucleotide"
aguuucuugaucuucuucuuu

SEQ ID NO: 2174 - RNA, 21 nt, Artificial Sequence
  source: /note="Description of Artificial Sequence: Synthetic oligonucleotide"
aguuucuugaucuucuucuuu

SEQ ID NO: 2175 - RNA, 21 nt, Artificial Sequence
  source: /note="Description of Artificial Sequence: Synthetic oligonucleotide"
aguuucuugaucuucuucuuu

SEQ ID NO: 2176 - RNA, 19 nt, Artificial Sequence
  source: /note="Description of Artificial Sequence: Synthetic oligonucleotide"
aguuucuugaucuucuucu

SEQ ID NO: 2177 - RNA, 21 nt, Artificial Sequence
  source: /note="Description of Artificial Sequence: Synthetic oligonucleotide"
ugagaauuccuuugauguuuu

SEQ ID NO: 2178 - RNA, 21 nt, Artificial Sequence
  source: /note="Description of Artificial Sequence: Synthetic oligonucleotide"
ugagaauuccuuugauguuuu

SEQ ID NO: 2179 - RNA, 21 nt, Artificial Sequence
  source: /note="Description of Artificial Sequence: Synthetic oligonucleotide"
ugagaauuccuuugauguuuu

SEQ ID NO: 2180 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagaauuccutugauguuuu

SEQ ID NO: 2181 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagaauuccutugauguuuu

SEQ ID NO: 2182 - RNA, 19 nt, Artificial Sequence
  source: /note="Description of Artificial Sequence: Synthetic oligonucleotide"
ugagaauuccuuugauguu

SEQ ID NO: 2183 - RNA, 21 nt, Artificial Sequence
  source: /note="Description of Artificial Sequence: Synthetic oligonucleotide"
uuucuuuccgagaauuccuuu

SEQ ID NO: 2184 - RNA, 21 nt, Artificial Sequence
  source: /note="Description of Artificial Sequence: Synthetic oligonucleotide"
uuucuuuccgagaauuccuuu

SEQ ID NO: 2185 - RNA, 21 nt, Artificial Sequence
  source: /note="Description of Artificial Sequence: Synthetic oligonucleotide"
uuucuuuccgagaauuccuuu

SEQ ID NO: 2186 - RNA, 21 nt, Artificial Sequence
  source: /note="Description of Artificial Sequence: Synthetic oligonucleotide"
uuucuuuccgagaauuccuuu

SEQ ID NO: 2187 - RNA, 21 nt, Artificial Sequence
  source: /note="Description of Artificial Sequence: Synthetic oligonucleotide"
uuucuuuccgagaauuccuuu

SEQ ID NO: 2188 - RNA, 21 nt, Artificial Sequence
  source: /note="Description of Artificial Sequence: Synthetic oligonucleotide"
uuucuuuccgagaauuccuuu

SEQ ID NO: 2189 - RNA, 21 nt, Artificial Sequence
  source: /note="Description of Artificial Sequence: Synthetic oligonucleotide"
ucuuuccgagaauuccuuuuu

SEQ ID NO: 2190 - RNA, 21 nt, Artificial Sequence
  source: /note="Description of Artificial Sequence: Synthetic oligonucleotide"
ucuuuccgagaauuccuuuuu

SEQ ID NO: 2191 - RNA, 21 nt, Artificial Sequence
  source: /note="Description of Artificial Sequence: Synthetic oligonucleotide"
ucuuuccgagaauuccuuuuu

SEQ ID NO: 2192 - RNA, 21 nt, Artificial Sequence
  source: /note="Description of Artificial Sequence: Synthetic oligonucleotide"
ucuuuccgagaauuccuuuuu

SEQ ID NO: 2193 - RNA, 21 nt, Artificial Sequence
  source: /note="Description of Artificial Sequence: Synthetic oligonucleotide"
ucuuuccgagaauuccuuuuu

SEQ ID NO: 2194 - RNA, 21 nt, Artificial Sequence
  source: /note="Description of Artificial Sequence: Synthetic oligonucleotide"
ucuuuccgagaauuccuuuga

SEQ ID NO: 2195 - RNA, 21 nt, Artificial Sequence
  source: /note="Description of Artificial Sequence: Synthetic oligonucleotide"
ucccaagaaggccaaaagaga

SEQ ID NO: 2196 - RNA, 21 nt, Artificial Sequence
  source: /note="Description of Artificial Sequence: Synthetic oligonucleotide"
aguuucuugaucuucuucuuu

SEQ ID NO: 2197 - RNA, 21 nt, Artificial Sequence
  source: /note="Description of Artificial Sequence: Synthetic oligonucleotide"
ucuuuucugauaaagaggaga

SEQ ID NO: 2198 - RNA, 21 nt, Artificial Sequence
  source: /note="Description of Artificial Sequence: Synthetic oligonucleotide"
agugguaaagaguauuggaaa

SEQ ID NO: 2199 - RNA, 21 nt, Artificial Sequence
  source: /note="Description of Artificial Sequence: Synthetic oligonucleotide"
cucaaguuucuugaucuucuu

SEQ ID NO: 2200 - RNA, 21 nt, Artificial Sequence
  source: /note="Description of Artificial Sequence: Synthetic oligonucleotide"
aaggccaaaagagaauacaaa

SEQ ID NO: 2201 - RNA, 21 nt, Artificial Sequence
  source: /note="Description of Artificial Sequence: Synthetic oligonucleotide"
gaccucaaguuucuugaucuu

SEQ ID NO: 2202 - RNA, 21 nt, Artificial Sequence
  source: /note="Description of Artificial Sequence: Synthetic oligonucleotide"
aggccaaaagagaauacaaga

SEQ ID NO: 2203 - RNA, 21 nt, Artificial Sequence
  source: /note="Description of Artificial Sequence: Synthetic oligonucleotide"
cgauagagaaucgagagaaaa

SEQ ID NO: 2204 - RNA, 21 nt, Artificial Sequence
  source: /note="Description of Artificial Sequence: Synthetic oligonucleotide"
gauagagaaucgagagaaaag

SEQ ID NO: 2205 - RNA, 21 nt, Artificial Sequence
  source: /note="Description of Artificial Sequence: Synthetic oligonucleotide"
acccacaaaucucucuagauu

SEQ ID NO: 2206 - RNA, 21 nt, Artificial Sequence
  source: /note="Description of Artificial Sequence: Synthetic oligonucleotide"
ggaugggaagaguauauccua

SEQ ID NO: 2207 - RNA, 21 nt, Artificial Sequence
  source: /note="Description of Artificial Sequence: Synthetic oligonucleotide"
ccgauagagaaucgagagaaa

SEQ ID NO: 2208 - RNA, 21 nt, Artificial Sequence
  source: /note="Description of Artificial Sequence: Synthetic oligonucleotide"
uccgauagagaaucgagagaa

SEQ ID NO: 2209 - RNA, 21 nt, Artificial Sequence
  source: /note="Description of Artificial Sequence: Synthetic oligonucleotide"
ugaguggaaacccgcuuuauu

SEQ ID NO: 2210 - RNA, 21 nt, Artificial Sequence
  source: /note="Description of Artificial Sequence: Synthetic oligonucleotide"
ccuucuuuccgagaauuccuu

SEQ ID NO: 2211 - RNA, 21 nt, Artificial Sequence
  source: /note="Description of Artificial Sequence: Synthetic oligonucleotide"
cugugaguggaaacccgcuuu

SEQ ID NO: 2212 - RNA, 21 nt, Artificial Sequence
  source: /note="Description of Artificial Sequence: Synthetic oligonucleotide"
gacccacaaaucucucuagau

SEQ ID NO: 2213 - RNA, 21 nt, Artificial Sequence
  source: /note="Description of Artificial Sequence: Synthetic oligonucleotide"
gcugggaaacaucaaaggaau

SEQ ID NO: 2214 - RNA, 21 nt, Artificial Sequence
  source: /note="Description of Artificial Sequence: Synthetic oligonucleotide"
acaguuggaaggcucaaggag

SEQ ID NO: 2215 - RNA, 21 nt, Artificial Sequence
  source: /note="Description of Artificial Sequence: Synthetic oligonucleotide"
aaggaggaggaacgaguccga

SEQ ID NO: 2216 - RNA, 21 nt, Artificial Sequence
  source: /note="Description of Artificial Sequence: Synthetic oligonucleotide"
ucuccucuuuaucagaaaaga

SEQ ID NO: 2217 - RNA, 21 nt, Artificial Sequence
  source: /note="Description of Artificial Sequence: Synthetic oligonucleotide"
uccagcagucuccucuuuaua

SEQ ID NO: 2218 - RNA, 21 nt, Artificial Sequence
  source: /note="Description of Artificial Sequence: Synthetic oligonucleotide"
aaagaagaagaucaagaaacu

SEQ ID NO: 2219 - RNA, 21 nt, Artificial Sequence
  source: /note="Description of Artificial Sequence: Synthetic oligonucleotide"
aagaagaagaucaagaaacuu

SEQ ID NO: 2220 - RNA, 21 nt, Artificial Sequence
  source: /note="Description of Artificial Sequence: Synthetic oligonucleotide"
gaggucgaaaaucccuggcua

SEQ ID NO: 2221 - RNA, 21 nt, Artificial Sequence
  source: /note="Description of Artificial Sequence: Synthetic oligonucleotide"
cccuggcugggaaacaucaaa

SEQ ID NO: 2222 - RNA, 21 nt, Artificial Sequence
  source: /note="Description of Artificial Sequence: Synthetic oligonucleotide"
cuggcugggaaacaucaaaga

SEQ ID NO: 2223 - RNA, 21 nt, Artificial Sequence
  source: /note="Description of Artificial Sequence: Synthetic oligonucleotide"
uggcugggaaacaucaaagga

SEQ ID NO: 2224 - RNA, 21 nt, Artificial Sequence
  source: /note="Description of Artificial Sequence: Synthetic oligonucleotide"
ggcugggaaacaucaaaggaa

SEQ ID NO: 2225 - RNA, 21 nt, Artificial Sequence
  source: /note="Description of Artificial Sequence: Synthetic oligonucleotide"
ucaaaggaauucucggaaaga

SEQ ID NO: 2226 - RNA, 21 nt, Artificial Sequence
  source: /note="Description of Artificial Sequence: Synthetic oligonucleotide"
ugggaaacaucaaaggaauua

SEQ ID NO: 2227 - RNA, 21 nt, Artificial Sequence
  source: /note="Description of Artificial Sequence: Synthetic oligonucleotide"
ggaaacaucaaaggaauucua

SEQ ID NO: 2228 - RNA, 21 nt, Artificial Sequence
  source: /note="Description of Artificial Sequence: Synthetic oligonucleotide"
gaaacaucaaaggaauucuca

SEQ ID NO: 2229 - RNA, 21 nt, Artificial Sequence
  source: /note="Description of Artificial Sequence: Synthetic oligonucleotide"
aaacaucaaaggaauucucga

SEQ ID NO: 2230 - RNA, 21 nt, Artificial Sequence
  source: /note="Description of Artificial Sequence: Synthetic oligonucleotide"
caucaaaggaauucucggaaa

SEQ ID NO: 2231 - RNA, 21 nt, Artificial Sequence
  source: /note="Description of Artificial Sequence: Synthetic oligonucleotide"
aaaggaauucucggaaagaaa

SEQ ID NO: 2232 - RNA, 21 nt, Artificial Sequence
  source: /note="Description of Artificial Sequence: Synthetic oligonucleotide"
aaggaauucucggaaagaaga

SEQ ID NO: 2233 - RNA, 21 nt, Artificial Sequence
  source: /note="Description of Artificial Sequence: Synthetic oligonucleotide"
ggcccucgagaacaagaagaa

SEQ ID NO: 2234 - RNA, 21 nt, Artificial Sequence
  source: /note="Description of Artificial Sequence: Synthetic oligonucleotide"
gcccucgagaacaagaagaaa

SEQ ID NO: 2235 - RNA, 21 nt, Artificial Sequence
  source: /note="Description of Artificial Sequence: Synthetic oligonucleotide"
cccucgagaacaagaagaaga

SEQ ID NO: 2236 - RNA, 21 nt, Artificial Sequence
  source: /note="Description of Artificial Sequence: Synthetic oligonucleotide"
ggaaaggaaaagaagaguaga

SEQ ID NO: 2237 - RNA, 21 nt, Artificial Sequence
  source: /note="Description of Artificial Sequence: Synthetic oligonucleotide"
aaggaaaagaagaguagccga

SEQ ID NO: 2238 - RNA, 21 nt, Artificial Sequence
  source: /note="Description of Artificial Sequence: Synthetic oligonucleotide"
gggggugugaacccccucgaa

SEQ ID NO: 2239 - RNA, 21 nt, Artificial Sequence
  source: /note="Description of Artificial Sequence: Synthetic oligonucleotide"
gggugugaacccccucgaaga

SEQ ID NO: 2240 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
naguuucuugaucuucuucuuu

SEQ ID NO: 2241 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nucuuuucugauaaagaggaga

SEQ ID NO: 2242 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nagugguaaagaguauuggaaa

SEQ ID NO: 2243 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ncucaaguuucuugaucuucuu

SEQ ID NO: 2244 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
naaggccaaaagagaauacaaa

SEQ ID NO: 2245 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
naggccaaaagagaauacaaga

SEQ ID NO: 2246 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ncgauagagaaucgagagaaaa

SEQ ID NO: 2247 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ngauagagaaucgagagaaaag

SEQ ID NO: 2248 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nacccacaaaucucucuagauu

SEQ ID NO: 2249 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nggaugggaagaguauauccua

SEQ ID NO: 2250 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nccgauagagaaucgagagaaa

SEQ ID NO: 2251 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nuccgauagagaaucgagagaa

SEQ ID NO: 2252 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nugaguggaaacccgcuuuauu

SEQ ID NO: 2253 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nccuucuuuccgagaauuccuu

SEQ ID NO: 2254 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ncugugaguggaaacccgcuuu

SEQ ID NO: 2255 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ngacccacaaaucucucuagau

SEQ ID NO: 2256 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ngcugggaaacaucaaaggaau

SEQ ID NO: 2257 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nacaguuggaaggcucaaggag

SEQ ID NO: 2258 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
naaggaggaggaacgaguccga

SEQ ID NO: 2259 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nucuccucuuuaucagaaaaga

SEQ ID NO: 2260 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nuccagcagucuccucuuuaua

SEQ ID NO: 2261 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
naaagaagaagaucaagaaacu

SEQ ID NO: 2262 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
naagaagaagaucaagaaacuu

SEQ ID NO: 2263 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ngaggucgaaaaucccuggcua

SEQ ID NO: 2264 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ncccuggcugggaaacaucaaa

SEQ ID NO: 2265 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ncuggcugggaaacaucaaaga

SEQ ID NO: 2266 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nuggcugggaaacaucaaagga

SEQ ID NO: 2267 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nggcugggaaacaucaaaggaa

SEQ ID NO: 2268 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nucaaaggaauucucggaaaga

SEQ ID NO: 2269 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nugggaaacaucaaaggaauua

SEQ ID NO: 2270 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nggaaacaucaaaggaauucua

SEQ ID NO: 2271 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ngaaacaucaaaggaauucuca

SEQ ID NO: 2272 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ncaucaaaggaauucucggaaa

SEQ ID NO: 2273 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
naaaggaauucucggaaagaaa

SEQ ID NO: 2274 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
naaggaauucucggaaagaaga

SEQ ID NO: 2275 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nacgaaggaaggcccucgagaa

SEQ ID NO: 2276 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nggcccucgagaacaagaagaa

SEQ ID NO: 2277 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ngcccucgagaacaagaagaaa

SEQ ID NO: 2278 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ncccucgagaacaagaagaaga

SEQ ID NO: 2279 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
nggaaaggaaaagaagaguaga

SEQ ID NO: 2280 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
naaggaaaagaagaguagccga

SEQ ID NO: 2281 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ngggggugugaacccccucgaa

SEQ ID NO: 2282 - RNA, 22 nt, Artificial Sequence
  source: /note="Description of Artificial Sequence: Synthetic oligonucleotide"
  modified_base (1)..(1): 2-hydroxymethyl-tetrahydrofurane-5-phosphate
ngggugugaacccccucgaaga

SEQ ID NO: 2283 - RNA, 19 nt, Artificial Sequence
  source: /note="Description of Artificial Sequence: Synthetic oligonucleotide"
aaacuugaggucgaaaaua

SEQ ID NO: 2284 - RNA, 19 nt, Artificial Sequence
  source: /note="Description of Artificial Sequence: Synthetic oligonucleotide"
aaacuugaggucgaaaaua

SEQ ID NO: 2285 - RNA, 19 nt, Artificial Sequence
  source: /note="Description of Artificial Sequence: Synthetic oligonucleotide"
aaacuugaggucgaaaaua

SEQ ID NO: 2286 - RNA, 19 nt, Artificial Sequence
  source: /note="Description of Artificial Sequence: Synthetic oligonucleotide"
aaacuugaggucgaaaaua

SEQ ID NO: 2287 - RNA, 21 nt, Artificial Sequence
  source: /note="Description of Artificial Sequence: Synthetic oligonucleotide"
agaaacuugaggucgaaaaua

SEQ ID NO: 2288 - RNA, 19 nt, Artificial Sequence
  source: /note="Description of Artificial Sequence: Synthetic oligonucleotide"
gaucaagaaacuugaggua

SEQ ID NO: 2289 - RNA, 19 nt, Artificial Sequence
  source: /note="Description of Artificial Sequence: Synthetic oligonucleotide"
gaucaagaaacuugaggua

SEQ ID NO: 2290 - RNA, 19 nt, Artificial Sequence
  source: /note="Description of Artificial Sequence: Synthetic oligonucleotide"
gaucaagaaacuugaggua

SEQ ID NO: 2291 - RNA, 21 nt, Artificial Sequence
  source: /note="Description of Artificial Sequence: Synthetic oligonucleotide"
aagaucaagaaacuugaggua

SEQ ID NO: 2292 - RNA, 19 nt, Artificial Sequence
  source: /note="Description of Artificial Sequence: Synthetic oligonucleotide"
ucaagaaacuugaggucga

SEQ ID NO: 2293 - RNA, 19 nt, Artificial Sequence
  source: /note="Description of Artificial Sequence: Synthetic oligonucleotide"
ucaagaaacuugaggucga

SEQ ID NO: 2294 - RNA, 19 nt, Artificial Sequence
  source: /note="Description of Artificial Sequence: Synthetic oligonucleotide"
ucaagaaacuugaggucga

SEQ ID NO: 2295 - RNA, 19 nt, Artificial Sequence
  source: /note="Description of Artificial Sequence: Synthetic oligonucleotide"
ucaagaaacuugaggucga

SEQ ID NO: 2296 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
ucaagaaacuugagcucga

SEQ ID NO: 2297 - RNA, 19 nt, Artificial Sequence
  source: /note="Description of Artificial Sequence: Synthetic oligonucleotide"
ucaagaaacuugaggucga

SEQ ID NO: 2298 - RNA, 19 nt, Artificial Sequence
  source: /note="Description of Artificial Sequence: Synthetic oligonucleotide"
aagaucaagaaacuugaga

SEQ ID NO: 2299 - RNA, 19 nt, Artificial Sequence
  source: /note="Description of Artificial Sequence: Synthetic oligonucleotide"
aagaucaagaaacuugaga

SEQ ID NO: 2300 - RNA, 19 nt, Artificial Sequence
  source: /note="Description of Artificial Sequence: Synthetic oligonucleotide"
aagaucaagaaacuugaga

SEQ ID NO: 2301 - RNA, 19 nt, Artificial Sequence
  source: /note="Description of Artificial Sequence: Synthetic oligonucleotide"
aagaucaagaaacuugaga

SEQ ID NO: 2302 - RNA, 19 nt, Artificial Sequence
  source: /note="Description of Artificial Sequence: Synthetic oligonucleotide"
aagaucaagaaacuagaga

SEQ ID NO: 2303 - RNA, 21 nt, Artificial Sequence
  source: /note="Description of Artificial Sequence: Synthetic oligonucleotide"
agaagaucaagaaacuugaga

SEQ ID NO: 2304 - RNA, 19 nt, Artificial Sequence
  source: /note="Description of Artificial Sequence: Synthetic oligonucleotide"
caucaaaggaauucucgga

SEQ ID NO: 2305 - RNA, 19 nt, Artificial Sequence
  source: /note="Description of Artificial Sequence: Synthetic oligonucleotide"
caucaaaggaauucucgga

SEQ ID NO: 2306 - RNA, 19 nt, Artificial Sequence
  source: /note="Description of Artificial Sequence: Synthetic oligonucleotide"
caucaaaggaauucucgga

SEQ ID NO: 2307 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
caucaaaggaauuctcgga

SEQ ID NO: 2308 - RNA, 21 nt, Artificial Sequence
  source: /note="Description of Artificial Sequence: Synthetic oligonucleotide"
aacaucaaaggaauucucgga

SEQ ID NO: 2309 - RNA, 19 nt, Artificial Sequence
  source: /note="Description of Artificial Sequence: Synthetic oligonucleotide"
aucaagaaacuugagguca

SEQ ID NO: 2310 - RNA, 19 nt, Artificial Sequence
  source: /note="Description of Artificial Sequence: Synthetic oligonucleotide"
aucaagaaacuugagguca

SEQ ID NO: 2311 - RNA, 19 nt, Artificial Sequence
  source: /note="Description of Artificial Sequence: Synthetic oligonucleotide"
aucaagaaacuugagguca

SEQ ID NO: 2312 - RNA, 19 nt, Artificial Sequence
  source: /note="Description of Artificial Sequence: Synthetic oligonucleotide"
aucaagaaacuugagguca

SEQ ID NO: 2313 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
aucaagaaacuugacguca

SEQ ID NO: 2314 - RNA, 21 nt, Artificial Sequence
  source: /note="Description of Artificial Sequence: Synthetic oligonucleotide"
agaucaagaaacuugagguca

SEQ ID NO: 2315 - RNA, 19 nt, Artificial Sequence
  source: /note="Description of Artificial Sequence: Synthetic oligonucleotide"
gaagaucaagaaacuugaa

SEQ ID NO: 2316 - RNA, 19 nt, Artificial Sequence
  source: /note="Description of Artificial Sequence: Synthetic oligonucleotide"
gaagaucaagaaacuugaa

SEQ ID NO: 2317 - RNA, 19 nt, Artificial Sequence
  source: /note="Description of Artificial Sequence: Synthetic oligonucleotide"
gaagaucaagaaacuugaa

SEQ ID NO: 2318 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
gaagaucaagaaactugaa

SEQ ID NO: 2319 - RNA, 21 nt, Artificial Sequence
  source: /note="Description of Artificial Sequence: Synthetic oligonucleotide"
aagaagaucaagaaacuugaa

SEQ ID NO: 2320 - RNA, 19 nt, Artificial Sequence
  source: /note="Description of Artificial Sequence: Synthetic oligonucleotide"
caaaggaauucucggaaag

SEQ ID NO: 2321 - RNA, 19 nt, Artificial Sequence
  source: /note="Description of Artificial Sequence: Synthetic oligonucleotide"
caaaggaauucucggaaag

SEQ ID NO: 2322 - RNA, 19 nt, Artificial Sequence
  source: /note="Description of Artificial Sequence: Synthetic oligonucleotide"
caaaggaauucucggaaag

SEQ ID NO: 2323 - RNA, 19 nt, Artificial Sequence
  source: /note="Description of Artificial Sequence: Synthetic oligonucleotide"
caaaggaauucucggaaag

SEQ ID NO: 2324 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
caaaggaauucucgcaaag

SEQ ID NO: 2325 - RNA, 21 nt, Artificial Sequence
  source: /note="Description of Artificial Sequence: Synthetic oligonucleotide"
aucaaaggaauucucggaaag

SEQ ID NO: 2326 - RNA, 19 nt, Artificial Sequence
  source: /note="Description of Artificial Sequence: Synthetic oligonucleotide"
caagaaacuugaggucgaa

SEQ ID NO: 2327 - RNA, 19 nt, Artificial Sequence
  source: /note="Description of Artificial Sequence: Synthetic oligonucleotide"
caagaaacuugaggucgaa

SEQ ID NO: 2328 - RNA, 19 nt, Artificial Sequence
  source: /note="Description of Artificial Sequence: Synthetic oligonucleotide"
caagaaacuugaggucgaa

SEQ ID NO: 2329 - RNA, 19 nt, Artificial Sequence
  source: /note="Description of Artificial Sequence: Synthetic oligonucleotide"
caagaaacuugaggucgaa

SEQ ID NO: 2330 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
caagaaacuugaggtcgaa

SEQ ID NO: 2331 - RNA, 21 nt, Artificial Sequence
  source: /note="Description of Artificial Sequence: Synthetic oligonucleotide"
aucaagaaacuugaggucgaa

SEQ ID NO: 2332 - RNA, 19 nt, Artificial Sequence
  source: /note="Description of Artificial Sequence: Synthetic oligonucleotide"
gaagaagaucaagaaacuu

SEQ ID NO: 2333 - RNA, 19 nt, Artificial Sequence
  source: /note="Description of Artificial Sequence: Synthetic oligonucleotide"
gaagaagaucaagaaacuu

SEQ ID NO: 2334 - RNA, 19 nt, Artificial Sequence
  source: /note="Description of Artificial Sequence: Synthetic oligonucleotide"
gaagaagaucaagaaacuu

SEQ ID NO: 2335 - RNA, 19 nt, Artificial Sequence
  source: /note="Description of Artificial Sequence: Synthetic oligonucleotide"
gaagaagaucaagaaacuu

SEQ ID NO: 2336 - RNA, 19 nt, Artificial Sequence
  source: /note="Description of Artificial Sequence: Synthetic oligonucleotide"
gaagaagaucaagaaacuu

SEQ ID NO: 2337 - RNA, 21 nt, Artificial Sequence
  source: /note="Description of Artificial Sequence: Synthetic oligonucleotide"
aagaagaagaucaagaaacuu

SEQ ID NO: 2338 - RNA, 19 nt, Artificial Sequence
  source: /note="Description of Artificial Sequence: Synthetic oligonucleotide"
ggaaacaucaaaggaauua

SEQ ID NO: 2339 - RNA, 19 nt, Artificial Sequence
  source: /note="Description of Artificial Sequence: Synthetic oligonucleotide"
ggaaacaucaaaggaauua

SEQ ID NO: 2340 - RNA, 19 nt, Artificial Sequence
  source: /note="Description of Artificial Sequence: Synthetic oligonucleotide"
ggaaacaucaaaggaauua

SEQ ID NO: 2341 - RNA, 19 nt, Artificial Sequence
  source: /note="Description of Artificial Sequence: Synthetic oligonucleotide"
ggaaacaucaaaggaauua

SEQ ID NO: 2342 - RNA, 19 nt, Artificial Sequence
  source: /note="Description of Artificial Sequence: Synthetic oligonucleotide"
ggaaacaucaaaggaauua

SEQ ID NO: 2343 - RNA, 21 nt, Artificial Sequence
  source: /note="Description of Artificial Sequence: Synthetic oligonucleotide"
ugggaaacaucaaaggaauua

SEQ ID NO: 2344 - RNA, 21 nt, Artificial Sequence
  source: /note="Description of Artificial Sequence: Synthetic oligonucleotide"
aaagaagaagaucaagaaacu

SEQ ID NO: 2345 - RNA, 21 nt, Artificial Sequence
  source: /note="Description of Artificial Sequence: Synthetic oligonucleotide"
aaagaagaagaucaagaaacu

SEQ ID NO: 2346 - RNA, 21 nt, Artificial Sequence
  source: /note="Description of Artificial Sequence: Synthetic oligonucleotide"
aaagaagaagaucaagaaacu

SEQ ID NO: 2347 - RNA, 21 nt, Artificial Sequence
  source: /note="Description of Artificial Sequence: Synthetic oligonucleotide"
aaagaagaagaucaagaaacu

SEQ ID NO: 2348 - RNA, 21 nt, Artificial Sequence
  source: /note="Description of Artificial Sequence: Synthetic oligonucleotide"
aaagaagaagaucaagaaacu

SEQ ID NO: 2349 - RNA, 19 nt, Artificial Sequence
  source: /note="Description of Artificial Sequence: Synthetic oligonucleotide"
agaagaagaucaagaaacu

SEQ ID NO: 2350 - RNA, 19 nt, Artificial Sequence
  source: /note="Description of Artificial Sequence: Synthetic oligonucleotide"
agaagaagaucaagaaacu

SEQ ID NO: 2351 - RNA, 19 nt, Artificial Sequence
  source: /note="Description of Artificial Sequence: Synthetic oligonucleotide"
agaagaagaucaagaaacu

SEQ ID NO: 2352 - RNA, 19 nt, Artificial Sequence
  source: /note="Description of Artificial Sequence: Synthetic oligonucleotide"
agaagaagaucaagaaacu

SEQ ID NO: 2353 - RNA, 19 nt, Artificial Sequence
  source: /note="Description of Artificial Sequence: Synthetic oligonucleotide"
agaagaagaucaagaaacu

SEQ ID NO: 2354 - RNA, 19 nt, Artificial Sequence
  source: /note="Description of Artificial Sequence: Synthetic oligonucleotide"
agaagaagaucaagaaacu

SEQ ID NO: 2355 - RNA, 19 nt, Artificial Sequence
  source: /note="Description of Artificial Sequence: Synthetic oligonucleotide"
aacaucaaaggaauucuca

SEQ ID NO: 2356 - RNA, 19 nt, Artificial Sequence
  source: /note="Description of Artificial Sequence: Synthetic oligonucleotide"
aacaucaaaggaauucuca

SEQ ID NO: 2357 - RNA, 19 nt, Artificial Sequence
  source: /note="Description of Artificial Sequence: Synthetic oligonucleotide"
aacaucaaaggaauucuca

SEQ ID NO: 2358 - RNA, 19 nt, Artificial Sequence
  source: /note="Description of Artificial Sequence: Synthetic oligonucleotide"
aacaucaaaggaauucuca

SEQ ID NO: 2359 - DNA, 19 bp, Artificial Sequence
  source: /note="Description of Artificial Sequence: Synthetic oligonucleotide"
  source: /note="Description of Combined DNA/RNA Molecule: Synthetic oligonucleotide"
aacaucaaaggaautcuca

SEQ ID NO: 2360 - RNA, 19 nt, Artificial Sequence
  source: /note="Description of Artificial Sequence: Synthetic oligonucleotide"
aacaucaaaggaauucuca

SEQ ID NO: 2361 - RNA, 19 nt, Artificial Sequence
  source: /note="Description of Artificial Sequence: Synthetic oligonucleotide"
aggaauucucggaaagaaa

SEQ ID NO: 2362 - RNA, 19 nt, Artificial Sequence
  source: /note="Description of Artificial Sequence: Synthetic oligonucleotide"
aggaauucucggaaagaaa

SEQ ID NO: 2363 - RNA, 19 nt, Artificial Sequence
  source: /note="Description of Artificial Sequence: Synthetic oligonucleotide"
aggaauucucggaaagaaa

SEQ ID NO: 2364 - RNA, 19 nt, Artificial Sequence
  source: /note="Description of Artificial Sequence: Synthetic oligonucleotide"
aggaauucucggaaagaaa

SEQ ID NO: 2365 - RNA, 19 nt, Artificial Sequence
  source: /note="Description of Artificial Sequence: Synthetic oligonucleotide"
aggaauucucggaaagaaa

SEQ ID NO: 2366 - RNA, 21 nt, Artificial Sequence
  source: /note="Description of Artificial Sequence: Synthetic oligonucleotide"
aaaggaauucucggaaagaaa

SEQ ID NO: 2367 - RNA, 19 nt, Artificial Sequence
  source: /note="Description of Artificial Sequence: Synthetic oligonucleotide"
aaaggaauucucggaaaga

SEQ ID NO: 2368 - RNA, 19 nt, Artificial Sequence
  source: /note="Description of Artificial Sequence: Synthetic oligonucleotide"
aaaggaauucucggaaaga

SEQ ID NO: 2369 - RNA, 19 nt, Artificial Sequence
  source: /note="Description of Artificial Sequence: Synthetic oligonucleotide"
aaaggaauucucggaaaga

SEQ ID NO: 2370 - RNA, 19 nt, Artificial Sequence
  source: /note="Description of Artificial Sequence: Synthetic oligonucleotide"
aaaggaauucucggaaaga

SEQ ID NO: 2371 - RNA, 19 nt, Artificial Sequence
  source: /note="Description of Artificial Sequence: Synthetic oligonucleotide"
aaaggaauucucggaaaga

SEQ ID NO: 2372 - RNA, 21 nt, Artificial Sequence
  source: /note="Description of Artificial Sequence: Synthetic oligonucleotide"
ucaaaggaauucucggaaaga

SEQ ID NO: 2373 - RNA, 23 nt, Artificial Sequence
  source: /note="Description of Artificial Sequence: Synthetic oligonucleotide"
ucucuuuuggccuucuugggaga

SEQ ID NO: 2374 - RNA, 23 nt, Artificial Sequence
  source: /note="Description of Artificial Sequence: Synthetic oligonucleotide"
aaagaagaagaucaagaaacuug

SEQ ID NO: 2375 - RNA, 23 nt, Artificial Sequence
  source: /note="Description of Artificial Sequence: Synthetic oligonucleotide"
ucuccucuuuaucagaaaagagu

SEQ ID NO: 2376 - RNA, 23 nt, Artificial Sequence
  source: /note="Description of Artificial Sequence: Synthetic oligonucleotide"
uuuccaauacucuuuaccacuuu

SEQ ID NO: 2377 - RNA, 23 nt, Artificial Sequence
  source: /note="Description of Artificial Sequence: Synthetic oligonucleotide"
aagaagaucaagaaacuugaggu

SEQ ID NO: 2378 - RNA, 23 nt, Artificial Sequence
  source: /note="Description of Artificial Sequence: Synthetic oligonucleotide"
uuuguauucucuuuuggccuucu

SEQ ID NO: 2379 - RNA, 23 nt, Artificial Sequence
  source: /note="Description of Artificial Sequence: Synthetic oligonucleotide"
aagaucaagaaacuugaggucga

SEQ ID NO: 2380 - RNA, 23 nt, Artificial Sequence
  source: /note="Description of Artificial Sequence: Synthetic oligonucleotide"
ucuuguauucucuuuuggccuuc

SEQ ID NO: 2381 - RNA, 23 nt, Artificial Sequence
  source: /note="Description of Artificial Sequence: Synthetic oligonucleotide"
uuuucucucgauucucuaucgga

SEQ ID NO: 2382 - RNA, 23 nt, Artificial Sequence
  source: /note="Description of Artificial Sequence: Synthetic oligonucleotide"
cuuuucucucgauucucuaucgg

SEQ ID NO: 2383 - RNA, 23 nt, Artificial Sequence
  source: /note="Description of Artificial Sequence: Synthetic oligonucleotide"
aaucuagagagauuugugggucc

SEQ ID NO: 2384 - RNA, 23 nt, Artificial Sequence
  source: /note="Description of Artificial Sequence: Synthetic oligonucleotide"
uaggauauacucuucccauccga

SEQ ID NO: 2385 - RNA, 23 nt, Artificial Sequence
  source: /note="Description of Artificial Sequence: Synthetic oligonucleotide"
uuucucucgauucucuaucggaa

SEQ ID NO: 2386 - RNA, 23 nt, Artificial Sequence
  source: /note="Description of Artificial Sequence: Synthetic oligonucleotide"
uucucucgauucucuaucggaau

SEQ ID NO: 2387 - RNA, 23 nt, Artificial Sequence
  source: /note="Description of Artificial Sequence: Synthetic oligonucleotide"
aauaaagcggguuuccacucaca

SEQ ID NO: 2388 - RNA, 23 nt, Artificial Sequence
  source: /note="Description of Artificial Sequence: Synthetic oligonucleotide"
aaggaauucucggaaagaaggac

SEQ ID NO: 2389 - RNA, 23 nt, Artificial Sequence
  source: /note="Description of Artificial Sequence: Synthetic oligonucleotide"
aaagcggguuuccacucacaggu

SEQ ID NO: 2390 - RNA, 23 nt, Artificial Sequence
  source: /note="Description of Artificial Sequence: Synthetic oligonucleotide"
aucuagagagauuuguggguccc

SEQ ID NO: 2391 - RNA, 23 nt, Artificial Sequence
  source: /note="Description of Artificial Sequence: Synthetic oligonucleotide"
auuccuuugauguuucccagcca

SEQ ID NO: 2392 - RNA, 23 nt, Artificial Sequence
  source: /note="Description of Artificial Sequence: Synthetic oligonucleotide"
ugucaaccuuccgaguuccucuu

SEQ ID NO: 2393 - RNA, 23 nt, Artificial Sequence
  source: /note="Description of Artificial Sequence: Synthetic oligonucleotide"
uuccuccuccuugcucaggcucu

SEQ ID NO: 2394 - RNA, 23 nt, Artificial Sequence
  source: /note="Description of Artificial Sequence: Synthetic oligonucleotide"
ucuuuucugauaaagaggagacu

SEQ ID NO: 2395 - RNA, 23 nt, Artificial Sequence
  source: /note="Description of Artificial Sequence: Synthetic oligonucleotide"
uauaaagaggagacugcuggacu

SEQ ID NO: 2396 - RNA, 23 nt, Artificial Sequence
  source: /note="Description of Artificial Sequence: Synthetic oligonucleotide"
aguuucuugaucuucuucuuugu

SEQ ID NO: 2397 - RNA, 23 nt, Artificial Sequence
  source: /note="Description of Artificial Sequence: Synthetic oligonucleotide"
aaguuucuugaucuucuucuuug

SEQ ID NO: 2398 - RNA, 23 nt, Artificial Sequence
  source: /note="Description of Artificial Sequence: Synthetic oligonucleotide"
uagccagggauuuucgaccucaa

SEQ ID NO: 2399 - RNA, 23 nt, Artificial Sequence
  source: /note="Description of Artificial Sequence: Synthetic oligonucleotide"
uuugauguuucccagccagggau

SEQ ID NO: 2400 - RNA, 23 nt, Artificial Sequence
  source: /note="Description of Artificial Sequence: Synthetic oligonucleotide"
ucuuugauguuucccagccaggg

SEQ ID NO: 2401 - RNA, 23 nt, Artificial Sequence
  source: /note="Description of Artificial Sequence: Synthetic oligonucleotide"
uccuuugauguuucccagccagg

SEQ ID NO: 2402 - RNA, 23 nt, Artificial Sequence
  source: /note="Description of Artificial Sequence: Synthetic oligonucleotide"
uuccuuugauguuucccagccag

SEQ ID NO: 2403 - RNA, 23 nt, Artificial Sequence
  source: /note="Description of Artificial Sequence: Synthetic oligonucleotide"
ucuuuccgagaauuccuuugaug

SEQ ID NO: 2404 - RNA, 23 nt, Artificial Sequence
  source: /note="Description of Artificial Sequence: Synthetic oligonucleotide"
uaauuccuuugauguuucccagc

SEQ ID NO: 2405 - RNA, 23 nt, Artificial Sequence
  source: /note="Description of Artificial Sequence: Synthetic oligonucleotide"
uagaauuccuuugauguuuccca

SEQ ID NO: 2406 - RNA, 23 nt, Artificial Sequence
  source: /note="Description of Artificial Sequence: Synthetic oligonucleotide"
ugagaauuccuuugauguuuccc

SEQ ID NO: 2407 - RNA, 23 nt, Artificial Sequence
  source: /note="Description of Artificial Sequence: Synthetic oligonucleotide"
ucgagaauuccuuugauguuucc

SEQ ID NO: 2408 - RNA, 23 nt, Artificial Sequence
  source: /note="Description of Artificial Sequence: Synthetic oligonucleotide"
uuuccgagaauuccuuugauguu

SEQ ID NO: 2409 - RNA, 23 nt, Artificial Sequence
  source: /note="Description of Artificial Sequence: Synthetic oligonucleotide"
uuucuuuccgagaauuccuuuga

SEQ ID NO: 2410 - RNA, 23 nt, Artificial Sequence
  source: /note="Description of Artificial Sequence: Synthetic oligonucleotide"
ucuucuuuccgagaauuccuuug

SEQ ID NO: 2411 - RNA, 23 nt, Artificial Sequence
  source: /note="Description of Artificial Sequence: Synthetic oligonucleotide"
uucuucuuguucucgagggccuu

SEQ ID NO: 2412 - RNA, 23 nt, Artificial Sequence
  source: /note="Description of Artificial Sequence: Synthetic oligonucleotide"
uuucuucuuguucucgagggccu

SEQ ID NO: 2413 - RNA, 23 nt, Artificial Sequence
  source: /note="Description of Artificial Sequence: Synthetic oligonucleotide"
ucuucuucuuguucucgagggcc

SEQ ID NO: 2414 - RNA, 23 nt, Artificial Sequence
  source: /note="Description of Artificial Sequence: Synthetic oligonucleotide"
ucuacucuucuuuuccuuuccuc

SEQ ID NO: 2415 - RNA, 23 nt, Artificial Sequence
  source: /note="Description of Artificial Sequence: Synthetic oligonucleotide"
ucggcuacucuucuuuuccuuuc

SEQ ID NO: 2416 - RNA, 23 nt, Artificial Sequence
  source: /note="Description of Artificial Sequence: Synthetic oligonucleotide"
uucgaggggguucacacccccaa

SEQ ID NO: 2417 - RNA, 23 nt, Artificial Sequence
  source: /note="Description of Artificial Sequence: Synthetic oligonucleotide"
ucuucgaggggguucacaccccc

SEQ ID NO: 2418 - RNA, 23 nt, Artificial Sequence
  source: /note="Description of Artificial Sequence: Synthetic oligonucleotide"
aaagaagaagaucaagaaacuug

SEQ ID NO: 2419 - RNA, 23 nt, Artificial Sequence
  source: /note="Description of Artificial Sequence: Synthetic oligonucleotide"
ucuccucuuuaucagaaaagagu

SEQ ID NO: 2420 - RNA, 23 nt, Artificial Sequence
  source: /note="Description of Artificial Sequence: Synthetic oligonucleotide"
uuuccaauacucuuuaccacuuu

SEQ ID NO: 2421 - RNA, 23 nt, Artificial Sequence
  source: /note="Description of Artificial Sequence: Synthetic oligonucleotide"
aagaagaucaagaaacuugaggu

SEQ ID NO: 2422 - RNA, 23 nt, Artificial Sequence
  source: /note="Description of Artificial Sequence: Synthetic oligonucleotide"
uuuguauucucuuuuggccuucu

SEQ ID NO: 2423 - RNA, 23 nt, Artificial Sequence
  source: /note="Description of Artificial Sequence: Synthetic oligonucleotide"
ucuuguauucucuuuuggccuuc

SEQ ID NO: 2424 - RNA, 23 nt, Artificial Sequence
  source: /note="Description of Artificial Sequence: Synthetic oligonucleotide"
uuuucucucgauucucuaucgga

SEQ ID NO: 2425 - RNA, 23 nt, Artificial Sequence
  source: /note="Description of Artificial Sequence: Synthetic oligonucleotide"
cuuuucucucgauucucuaucgg

SEQ ID NO: 2426 - RNA, 23 nt, Artificial Sequence
  source: /note="Description of Artificial Sequence: Synthetic oligonucleotide"
aaucuagagagauuugugggucc

SEQ ID NO: 2427 - RNA, 23 nt, Artificial Sequence
  source: /note="Description of Artificial Sequence: Synthetic oligonucleotide"
uaggauauacucuucccauccga

SEQ ID NO: 2428 - RNA, 23 nt, Artificial Sequence
  source: /note="Description of Artificial Sequence: Synthetic oligonucleotide"
uuucucucgauucucuaucggaa

SEQ ID NO: 2429 - RNA, 23 nt, Artificial Sequence
  source: /note="Description of Artificial Sequence: Synthetic oligonucleotide"
uucucucgauucucuaucggaau

SEQ ID NO: 2430 - RNA, 23 nt, Artificial Sequence
  source: /note="Description of Artificial Sequence: Synthetic oligonucleotide"
aauaaagcggguuuccacucaca

SEQ ID NO: 2431 - RNA, 23 nt, Artificial Sequence
  source: /note="Description of Artificial Sequence: Synthetic oligonucleotide"
aaggaauucucggaaagaaggac

SEQ ID NO: 2432 - RNA, 23 nt, Artificial Sequence
  source: /note="Description of Artificial Sequence: Synthetic oligonucleotide"
aaagcggguuuccacucacaggu

SEQ ID NO: 2433 - RNA, 23 nt, Artificial Sequence
  source: /note="Description of Artificial Sequence: Synthetic oligonucleotide"
aucuagagagauuuguggguccc

SEQ ID NO: 2434 - RNA, 23 nt, Artificial Sequence
  source: /note="Description of Artificial Sequence: Synthetic oligonucleotide"
auuccuuugauguuucccagcca

SEQ ID NO: 2435 - RNA, 23 nt, Artificial Sequence
  source: /note="Description of Artificial Sequence: Synthetic oligonucleotide"
ugucaaccuuccgaguuccucuu

SEQ ID NO: 2436 - RNA, 23 nt, Artificial Sequence
  source: /note="Description of Artificial Sequence: Synthetic oligonucleotide"
uuccuccuccuugcucaggcucu

SEQ ID NO: 2437 - RNA, 23 nt, Artificial Sequence
  source: /note="Description of Artificial Sequence: Synthetic oligonucleotide"
ucuuuucugauaaagaggagacu

SEQ ID NO: 2438 - RNA, 23 nt, Artificial Sequence
  source: /note="Description of Artificial Sequence: Synthetic oligonucleotide"
uauaaagaggagacugcuggacu

SEQ ID NO: 2439 - RNA, 23 nt, Artificial Sequence
  source: /note="Description of Artificial Sequence: Synthetic oligonucleotide"
aguuucuugaucuucuucuuugu

SEQ ID NO: 2440 - RNA, 23 nt, Artificial Sequence
  source: /note="Description of Artificial Sequence: Synthetic oligonucleotide"
aaguuucuugaucuucuucuuug

SEQ ID NO: 2441 - RNA, 23 nt, Artificial Sequence
  source: /note="Description of Artificial Sequence: Synthetic oligonucleotide"
uagccagggauuuucgaccucaa

SEQ ID NO: 2442 - RNA, 23 nt, Artificial Sequence
  source: /note="Description of Artificial Sequence: Synthetic oligonucleotide"
uuugauguuucccagccagggau

SEQ ID NO: 2443 - RNA, 23 nt, Artificial Sequence
  source: /note="Description of Artificial Sequence: Synthetic oligonucleotide"
ucuuugauguuucccagccaggg

SEQ ID NO: 2444 - RNA, 23 nt, Artificial Sequence
  source: /note="Description of Artificial Sequence: Synthetic oligonucleotide"
uccuuugauguuucccagccagg

SEQ ID NO: 2445 - RNA, 23 nt, Artificial Sequence
  source: /note="Description of Artificial Sequence: Synthetic oligonucleotide"
uuccuuugauguuucccagccag

SEQ ID NO: 2446 - RNA, 23 nt, Artificial Sequence
  source: /note="Description of Artificial Sequence: Synthetic oligonucleotide"
ucuuuccgagaauuccuuugaug

SEQ ID NO: 2447 - RNA, 23 nt, Artificial Sequence
  source: /note="Description of Artificial Sequence: Synthetic oligonucleotide"
uaauuccuuugauguuucccagc

SEQ ID NO: 2448 - RNA, 23 nt, Artificial Sequence
  source: /note="Description of Artificial Sequence: Synthetic oligonucleotide"
uagaauuccuuugauguuuccca

SEQ ID NO: 2449 - RNA, 23 nt, Artificial Sequence
  source: /note="Description of Artificial Sequence: Synthetic oligonucleotide"
ugagaauuccuuugauguuuccc

SEQ ID NO: 2450 - RNA, 23 nt, Artificial Sequence
  source: /note="Description of Artificial Sequence: Synthetic oligonucleotide"
uuuccgagaauuccuuugauguu

SEQ ID NO: 2451 - RNA, 23 nt, Artificial Sequence
  source: /note="Description of Artificial Sequence: Synthetic oligonucleotide"
uuucuuuccgagaauuccuuuga

SEQ ID NO: 2452 - RNA, 23 nt, Artificial Sequence
  source: /note="Description of Artificial Sequence: Synthetic oligonucleotide"
ucuucuuuccgagaauuccuuug

SEQ ID NO: 2453 - RNA, 23 nt, Artificial Sequence
  source: /note="Description of Artificial Sequence: Synthetic oligonucleotide"
uucucgagggccuuccuucgucg

SEQ ID NO: 2454 - RNA, 23 nt, Artificial Sequence
  source: /note="Description of Artificial Sequence: Synthetic oligonucleotide"
uucuucuuguucucgagggccuu

SEQ ID NO: 2455 - RNA, 23 nt, Artificial Sequence
  source: /note="Description of Artificial Sequence: Synthetic oligonucleotide"
uuucuucuuguucucgagggccu

SEQ ID NO: 2456 - RNA, 23 nt, Artificial Sequence
  source: /note="Description of Artificial Sequence: Synthetic oligonucleotide"
ucuucuucuuguucucgagggcc

SEQ ID NO: 2457 - RNA, 23 nt, Artificial Sequence
  source: /note="Description of Artificial Sequence: Synthetic oligonucleotide"
ucuacucuucuuuuccuuuccuc

SEQ ID NO: 2458 - RNA, 23 nt, Artificial Sequence
  source: /note="Description of Artificial Sequence: Synthetic oligonucleotide"
ucggcuacucuucuuuuccuuuc

SEQ ID NO: 2459 - RNA, 23 nt, Artificial Sequence
  source: /note="Description of Artificial Sequence: Synthetic oligonucleotide"
uucgaggggguucacacccccaa

SEQ ID NO: 2460 - RNA, 23 nt, Artificial Sequence
  source: /note="Description of Artificial Sequence: Synthetic oligonucleotide"
ucuucgaggggguucacaccccc

SEQ ID NO: 2461 - RNA, 21 nt, Artificial Sequence
  source: /note="Description of Artificial Sequence: Synthetic oligonucleotide"
uauuuucgaccucaaguuuuu

SEQ ID NO: 2462 - RNA, 21 nt, Artificial Sequence
  source: /note="Description of Artificial Sequence: Synthetic oligonucleotide"
uauuuucgaccucaaguuuuu

SEQ ID NO: 2463 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuuucgacctcaaguuuuu

SEQ ID NO: 2464 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uauuuucgacctcaaguuuuu

SEQ ID NO: 2465 - RNA, 21 nt, Artificial Sequence
  source: /note="Description of Artificial Sequence: Synthetic oligonucleotide"
uauuuucgaccucaaguuucu

SEQ ID NO: 2466 - RNA, 21 nt, Artificial Sequence
  source: /note="Description of Artificial Sequence: Synthetic oligonucleotide"
uaccucaaguuucuugaucuu

SEQ ID NO: 2467 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccucaaguutcuugaucuu

SEQ ID NO: 2468 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaccucaaguutcuugaucuu

SEQ ID NO: 2469 - RNA, 21 nt, Artificial Sequence
  source: /note="Description of Artificial Sequence: Synthetic oligonucleotide"
uaccucaaguuucuugaucuu

SEQ ID NO: 2470 - RNA, 21 nt, Artificial Sequence
  source: /note="Description of Artificial Sequence: Synthetic oligonucleotide"
ucgaccucaaguuucuugauu

SEQ ID NO: 2471 - RNA, 21 nt, Artificial Sequence
  source: /note="Description of Artificial Sequence: Synthetic oligonucleotide"
ucgaccucaaguuucuugauu

SEQ ID NO: 2472 - RNA, 21 nt, Artificial Sequence
  source: /note="Description of Artificial Sequence: Synthetic oligonucleotide"
ucgaccucaaguuucuugauu

SEQ ID NO: 2473 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaccucaagtuucuugauu

SEQ ID NO: 2474 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucgaccucaagtuucuugauu

SEQ ID NO: 2475 - RNA, 19 nt, Artificial Sequence
  source: /note="Description of Artificial Sequence: Synthetic oligonucleotide"
ucgaccucaaguuucuuga

SEQ ID NO: 2476 - RNA, 21 nt, Artificial Sequence
  source: /note="Description of Artificial Sequence: Synthetic oligonucleotide"
ucucaaguuucuugaucuuuu

SEQ ID NO: 2477 - RNA, 21 nt, Artificial Sequence
  source: /note="Description of Artificial Sequence: Synthetic oligonucleotide"
ucucaaguuucuugaucuuuu

SEQ ID NO: 2478 - RNA, 21 nt, Artificial Sequence
  source: /note="Description of Artificial Sequence: Synthetic oligonucleotide"
ucucaaguuucuugaucuuuu

SEQ ID NO: 2479 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucaaguuuctugaucuuuu

SEQ ID NO: 2480 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucucaaguuuctugaucuuuu

SEQ ID NO: 2481 - RNA, 21 nt, Artificial Sequence
  source: /note="Description of Artificial Sequence: Synthetic oligonucleotide"
ucucaaguuucuugaucuucu

SEQ ID NO: 2482 - RNA, 21 nt, Artificial Sequence
  source: /note="Description of Artificial Sequence: Synthetic oligonucleotide"
uccgagaauuccuuugauguu

SEQ ID NO: 2483 - RNA, 21 nt, Artificial Sequence
  source: /note="Description of Artificial Sequence: Synthetic oligonucleotide"
uccgagaauuccuuugauguu

SEQ ID NO: 2484 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgagaauuccuuugauguu

SEQ ID NO: 2485 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uccgagaauuccuuugauguu

SEQ ID NO: 2486 - RNA, 21 nt, Artificial Sequence
  source: /note="Description of Artificial Sequence: Synthetic oligonucleotide"
uccgagaauuccuuugauguu

SEQ ID NO: 2487 - RNA, 21 nt, Artificial Sequence
  source: /note="Description of Artificial Sequence: Synthetic oligonucleotide"
ugaccucaaguuucuugauuu

SEQ ID NO: 2488 - RNA, 21 nt, Artificial Sequence
  source: /note="Description of Artificial Sequence: Synthetic oligonucleotide"
ugaccucaaguuucuugauuu

SEQ ID NO: 2489 - RNA, 21 nt, Artificial Sequence
  source: /note="Description of Artificial Sequence: Synthetic oligonucleotide"
ugaccucaaguuucuugauuu

SEQ ID NO: 2490 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaccucaagutucuugauuu

SEQ ID NO: 2491 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugaccucaagutucuugauuu

SEQ ID NO: 2492 - RNA, 21 nt, Artificial Sequence
  source: /note="Description of Artificial Sequence: Synthetic oligonucleotide"
ugaccucaaguuucuugaucu

SEQ ID NO: 2493 - RNA, 21 nt, Artificial Sequence
  source: /note="Description of Artificial Sequence: Synthetic oligonucleotide"
uucaaguuucuugaucuucuu

SEQ ID NO: 2494 - RNA, 21 nt, Artificial Sequence
  source: /note="Description of Artificial Sequence: Synthetic oligonucleotide"
uucaaguuucuugaucuucuu

SEQ ID NO: 2495 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaaguuucutgaucuucuu

SEQ ID NO: 2496 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucaaguuucutgaucuucuu

SEQ ID NO: 2497 - RNA, 21 nt, Artificial Sequence
  source: /note="Description of Artificial Sequence: Synthetic oligonucleotide"
uucaaguuucuugaucuucuu

SEQ ID NO: 2498 - RNA, 21 nt, Artificial Sequence
  source: /note="Description of Artificial Sequence: Synthetic oligonucleotide"
cuuuccgagaauuccuuugau

SEQ ID NO: 2499 - RNA, 21 nt, Artificial Sequence
  source: /note="Description of Artificial Sequence: Synthetic oligonucleotide"
cuuuccgagaauuccuuugau

SEQ ID NO: 2500 - RNA, 21 nt, Artificial Sequence
  source: /note="Description of Artificial Sequence: Synthetic oligonucleotide"
cuuuccgagaauuccuuugau

SEQ ID NO: 2501 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuccgagaatuccuuugau

SEQ ID NO: 2502 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
cuuuccgagaatuccuuugau

SEQ ID NO: 2503 - RNA, 21 nt, Artificial Sequence
  source: /note="Description of Artificial Sequence: Synthetic oligonucleotide"
cuuuccgagaauuccuuugau

SEQ ID NO: 2504 - RNA, 21 nt, Artificial Sequence
  source: /note="Description of Artificial Sequence: Synthetic oligonucleotide"
uucgaccucaaguuucuugau

SEQ ID NO: 2505 - RNA, 21 nt, Artificial Sequence
  source: /note="Description of Artificial Sequence: Synthetic oligonucleotide"
uucgaccucaaguuucuugau

SEQ ID NO: 2506 - RNA, 21 nt, Artificial Sequence
  source: /note="Description of Artificial Sequence: Synthetic oligonucleotide"
uucgaccucaaguuucuugau

SEQ ID NO: 2507 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgaccucaaguuucuugau

SEQ ID NO: 2508 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uucgaccucaaguuucuugau

SEQ ID NO: 2509 - RNA, 21 nt, Artificial Sequence
  source: /note="Description of Artificial Sequence: Synthetic oligonucleotide"
uucgaccucaaguuucuugau

SEQ ID NO: 2510 - RNA, 21 nt, Artificial Sequence
  source: /note="Description of Artificial Sequence: Synthetic oligonucleotide"
aaguuucuugaucuucuucuu

SEQ ID NO: 2511 - RNA, 21 nt, Artificial Sequence
  source: /note="Description of Artificial Sequence: Synthetic oligonucleotide"
aaguuucuugaucuucuucuu

SEQ ID NO: 2512 - RNA, 21 nt, Artificial Sequence
  source: /note="Description of Artificial Sequence: Synthetic oligonucleotide"
aaguuucuugaucuucuucuu

SEQ ID NO: 2513 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguuucuugatcuucuucuu

SEQ ID NO: 2514 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aaguuucuugatcuucuucuu

SEQ ID NO: 2515 - RNA, 21 nt, Artificial Sequence
  source: /note="Description of Artificial Sequence: Synthetic oligonucleotide"
aaguuucuugaucuucuucuu

SEQ ID NO: 2516 - RNA, 21 nt, Artificial Sequence
  source: /note="Description of Artificial Sequence: Synthetic oligonucleotide"
uaauuccuuugauguuuccuu

SEQ ID NO: 2517 - RNA, 21 nt, Artificial Sequence
  source: /note="Description of Artificial Sequence: Synthetic oligonucleotide"
uaauuccuuugauguuuccuu

SEQ ID NO: 2518 - RNA, 21 nt, Artificial Sequence
  source: /note="Description of Artificial Sequence: Synthetic oligonucleotide"
uaauuccuuugauguuuccuu

SEQ ID NO: 2519 - DNA, 20 bp, Artificial Sequence
  source: /note="Description of Artificial Sequence: Synthetic oligonucleotide"
  source: /note="Description of Combined DNA/RNA Molecule: Synthetic oligonucleotide"
uaauuccuuugauguuucuu

SEQ ID NO: 2520 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uaauuccuuugauguuuccuu

SEQ ID NO: 2521 - RNA, 21 nt, Artificial Sequence
  source: /note="Description of Artificial Sequence: Synthetic oligonucleotide"
uaauuccuuugauguuuccca

SEQ ID NO: 2522 - RNA, 23 nt, Artificial Sequence
  source: /note="Description of Artificial Sequence: Synthetic oligonucleotide"
aguuucuugaucuucuucuuugu

SEQ ID NO: 2523 - RNA, 23 nt, Artificial Sequence
  source: /note="Description of Artificial Sequence: Synthetic oligonucleotide"
aguuucuugaucuucuucuuugu

SEQ ID NO: 2524 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguuucuugaucuucuucuuugu

SEQ ID NO: 2525 - DNA, 23 bp, Artificial Sequence
  source: /note="Description of Artificial Sequence: Synthetic oligonucleotide"
  source: /note="Description of Combined DNA/RNA Molecule: Synthetic oligonucleotide"
aguuucuugaucuucuucuuugu

SEQ ID NO: 2526 - RNA, 21 nt, Artificial Sequence
  source: /note="Description of Artificial Sequence: Synthetic oligonucleotide"
aguuucuugaucuucuucuuu

SEQ ID NO: 2527 - RNA, 21 nt, Artificial Sequence
  source: /note="Description of Artificial Sequence: Synthetic oligonucleotide"
aguuucuugaucuucuucuuu

SEQ ID NO: 2528 - RNA, 21 nt, Artificial Sequence
  source: /note="Description of Artificial Sequence: Synthetic oligonucleotide"
aguuucuugaucuucuucuuu

SEQ ID NO: 2529 - RNA, 21 nt, Artificial Sequence
  source: /note="Description of Artificial Sequence: Synthetic oligonucleotide"
aguuucuugaucuucuucuuu

SEQ ID NO: 2530 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuucuugaucuucuucuuu

SEQ ID NO: 2531 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
aguuucuugaucuucuucuuu

SEQ ID NO: 2532 - RNA, 19 nt, Artificial Sequence
  source: /note="Description of Artificial Sequence: Synthetic oligonucleotide"
aguuucuugaucuucuucu

SEQ ID NO: 2533 - RNA, 21 nt, Artificial Sequence
  source: /note="Description of Artificial Sequence: Synthetic oligonucleotide"
ugagaauuccuuugauguuuu

SEQ ID NO: 2534 - RNA, 21 nt, Artificial Sequence
  source: /note="Description of Artificial Sequence: Synthetic oligonucleotide"
ugagaauuccuuugauguuuu

SEQ ID NO: 2535 - RNA, 21 nt, Artificial Sequence
  source: /note="Description of Artificial Sequence: Synthetic oligonucleotide"
ugagaauuccuuugauguuuu

SEQ ID NO: 2536 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagaauuccutugauguuuu

SEQ ID NO: 2537 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ugagaauuccutugauguuuu

SEQ ID NO: 2538 - RNA, 19 nt, Artificial Sequence
  source: /note="Description of Artificial Sequence: Synthetic oligonucleotide"
ugagaauuccuuugauguu

SEQ ID NO: 2539 - RNA, 21 nt, Artificial Sequence
  source: /note="Description of Artificial Sequence: Synthetic oligonucleotide"
uuucuuuccgagaauuccuuu

SEQ ID NO: 2540 - RNA, 21 nt, Artificial Sequence
  source: /note="Description of Artificial Sequence: Synthetic oligonucleotide"
uuucuuuccgagaauuccuuu

SEQ ID NO: 2541 - RNA, 21 nt, Artificial Sequence
  source: /note="Description of Artificial Sequence: Synthetic oligonucleotide"
uuucuuuccgagaauuccuuu

SEQ ID NO: 2542 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucuuuccgagaauuccuuu

SEQ ID NO: 2543 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
uuucuuuccgagaauuccuuu

SEQ ID NO: 2544 - RNA, 21 nt, Artificial Sequence
  source: /note="Description of Artificial Sequence: Synthetic oligonucleotide"
uuucuuuccgagaauuccuuu

SEQ ID NO: 2545 - RNA, 21 nt, Artificial Sequence
  source: /note="Description of Artificial Sequence: Synthetic oligonucleotide"
ucuuuccgagaauuccuuuuu

SEQ ID NO: 2546 - RNA, 21 nt, Artificial Sequence
  source: /note="Description of Artificial Sequence: Synthetic oligonucleotide"
ucuuuccgagaauuccuuuuu

SEQ ID NO: 2547 - RNA, 21 nt, Artificial Sequence
  source: /note="Description of Artificial Sequence: Synthetic oligonucleotide"
ucuuuccgagaauuccuuuuu

SEQ ID NO: 2548 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuuccgagaauuccuuuuu

SEQ ID NO: 2549 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
ucuuuccgagaauuccuuuuu

SEQ ID NO: 2550 - RNA, 21 nt, Artificial Sequence
  source: /note="Description of Artificial Sequence: Synthetic oligonucleotide"
ucuuuccgagaauuccuuuga

SEQ ID NO: 2551 - DNA, 1676 bp, Hepatitis delta virus
catgggccaattccgagcgaagagtccgcgggggaaggatcagtgcccgagaggggtaaagtggtaaagagtattggaacgccgaggagatgtctcccaagaaggccaaaagagaatacaagagtcggaagctttccccataacgctggagacatctcggaaggggaaagaggacagatggaagagaagggggggcccccccgatccgaaaggcccgacgcccaagtttggagagcactccggccgaagggttgagaacaccagagggaggaacacactcggagatgagcagagaaatcacctccagaggaccccttcagcgaacagaggcgcttcgagcggtaggagtaaggccatagcgataggaggagatgctaggagtagggggagaccgaagcgaggaggaaagcaaagaaagcaacggggctagccggtgggtgttccgccccccgagaggggacgagtgaggcttatcccggggaactcgacttatcgtccccatctagcgggaccccggacccccttcgaaagtgaccggagggggtgctgggaacaccggggaccagtggagccatgggatgcccttcccgatgctcgattccgactccccccccaagggtcgcccaggaatggcgggaccccactctgcagggtccgcgttccatcctttcttacctgatggccggcatggtcccagcctcctcgctggcgccggctgggcaacattccgaggggaccgtcccctcggtaatggcgaatgggacccacaaatctctctagattccgatagagaatcgagagaaaagtggctctcccttagccatccgagtggacgtgcgtcctccttcggatgcccaggtcggaccgcgaggaggtggagatgccatgccgacccgaagaggaaagaaggacgcgagacggtgaacctgtgagtggaaacccgctttattcactggggacgacaactctggggagagaagggtggatcggatgggaagagtatatcctatgggaatccccgggttcctcttatgtccagcccctcccccgtccgagcgaagggggactccgggactccttgcatgctggggacgaagccgcccccgggcgctcccctcgatccgccttcgagggggttcacacccccaacccgcgggccggctactcttcttttcctttcctcgtcttcccgggtcaaccttccgagttcctcttcctcctccttgctcaggctcttccctcccgcggctagctgcttcttcttgttctcgagggccttccttcgtcggtgatcctgcctctccctgtcggtgaatcctcccctgagaggcctcttcctaggcccggagtctatctccatctggtccgtccgggccctcttcgccgggggagccccctctccatccctgtccttctttccgagaattcctttgatgtttcccagccagggattttcgacctcaagtttcttgatcttcttctttgtcttccggagatccctctcgagttcctccgctttctttcttccactcacccacttctcgagaatatcttctcttccatcgcgcttcttcttcaactcggaccggctcatctcgacaagaggcggcagtcctcagtgctcttactcttttctgataaagaggagactgctggactcgccgcccaagttcgag

SEQ ID NO: 2552 - DNA, 1676 bp, Hepatitis delta virus
ctcgaacttgggcggcgagtccagcagtctcctctttatcagaaaagagtaagagcactgaggactgccgcctcttgtcgagatgagccggtccgagttgaagaagaagcgcgatggaagagaagatattctcgagaagtgggtgagtggaagaaagaaagcggaggaactcgagagggatctccggaagacaaagaagaagatcaagaaacttgaggtcgaaaatccctggctgggaaacatcaaaggaattctcggaaagaaggacagggatggagagggggctcccccggcgaagagggcccggacggaccagatggagatagactccgggcctaggaagaggcctctcaggggaggattcaccgacagggagaggcaggatcaccgacgaaggaaggccctcgagaacaagaagaagcagctagccgcgggagggaagagcctgagcaaggaggaggaagaggaactcggaaggttgacccgggaagacgaggaaaggaaaagaagagtagccggcccgcgggttgggggtgtgaaccccctcgaaggcggatcgaggggagcgcccgggggcggcttcgtccccagcatgcaaggagtcccggagtcccccttcgctcggacgggggaggggctggacataagaggaacccggggattcccataggatatactcttcccatccgatccacccttctctccccagagttgtcgtccccagtgaataaagcgggtttccactcacaggttcaccgtctcgcgtccttctttcctcttcgggtcggcatggcatctccacctcctcgcggtccgacctgggcatccgaaggaggacgcacgtccactcggatggctaagggagagccacttttctctcgattctctatcggaatctagagagatttgtgggtcccattcgccattaccgaggggacggtcccctcggaatgttgcccagccggcgccagcgaggaggctgggaccatgccggccatcaggtaagaaaggatggaacgcggaccctgcagagtggggtcccgccattcctgggcgacccttggggggggagtcggaatcgagcatcgggaagggcatcccatggctccactggtccccggtgttcccagcaccccctccggtcactttcgaagggggtccggggtcccgctagatggggacgataagtcgagttccccgggataagcctcactcgtcccctctcggggggcggaacacccaccggctagccccgttgctttctttgctttcctcctcgcttcggtctccccctactcctagcatctcctcctatcgctatggccttactcctaccgctcgaagcgcctctgttcgctgaaggggtcctctggaggtgatttctctgctcatctccgagtgtgttcctccctctggtgttctcaacccttcggccggagtgctctccaaacttgggcgtcgggcctttcggatcgggggggcccccccttctcttccatctgtcctctttccccttccgagatgtctccagcgttatggggaaagcttccgactcttgtattctcttttggccttcttgggagacatctcctcggcgttccaatactctttaccactttacccctctcgggcactgatccttcccccgcggactcttcgctcggaattggcccatg

We claim:

1. A double stranded ribonucleic acid (RNAi) agent for inhibiting expression of hepatitis D virus (HDV) in a cell, wherein said double stranded RNAi agent comprises a sense strand and an antisense strand forming a double-stranded region, wherein the sense strand comprises at least 15 contiguous nucleotides differing by no more than 3 nucleotides from the nucleotide sequence of 5'-AAGAAGAUCAAGAAACUUGAA-3' (SEQ ID NO:1963), and the antisense strand comprises at least 15 contiguous nucleotides differing by no more than 3 nucleotides from the nucleotide sequence of 5'-UUCAAGUUUCUUGAUCUUCUU-3' (SEQ ID NO:2141), wherein substantially all of the nucleotides of said sense strand and substantially all of the nucleotides of said antisense strand are modified nucleotides, wherein said sense strand is conjugated to a ligand attached at the 3'-terminus, and wherein the ligand is one or more GalNAc derivatives attached through a bivalent or trivalent branched linker.

2. The double stranded RNAi agent of claim 1, wherein all of the nucleotides of said sense strand and all of the nucleotides of said antisense strand are modified nucleotides.

3. The double stranded RNAi agent of claim 1, wherein at least one of said modified nucleotides is selected from the group consisting of a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic.

4. The double stranded RNAi agent of any claim 1, wherein at least one strand comprises a 3' overhang of at least 1 nucleotide; or at least 2 nucleotides.

5. The double stranded RNAi agent of claim 1, wherein the double-stranded region is 15-30 nucleotide pairs in length; 17-23 nucleotide pairs in length; 17-25 nucleotide pairs in length; 23-27 nucleotide pairs in length; 19-21 nucleotide pairs in length; or 21-23 nucleotide pairs in length.

6. The double stranded RNAi agent of claim 1, wherein each strand is independently 15-30 nucleotides in length; or 19-30 nucleotides in length.

7. The double stranded RNAi agent of claim 1, wherein the ligand is

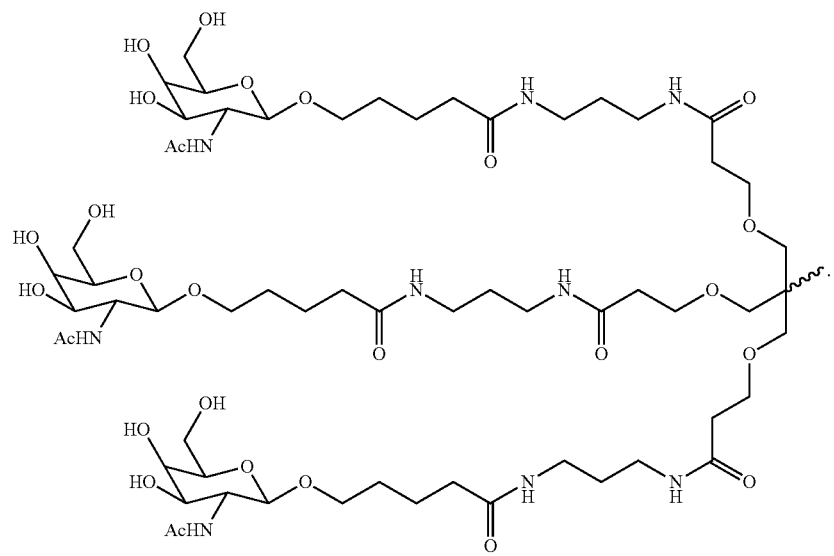

8. The double stranded RNAi agent of claim 1, wherein the RNAi agent is conjugated to the ligand as shown in the following schematic

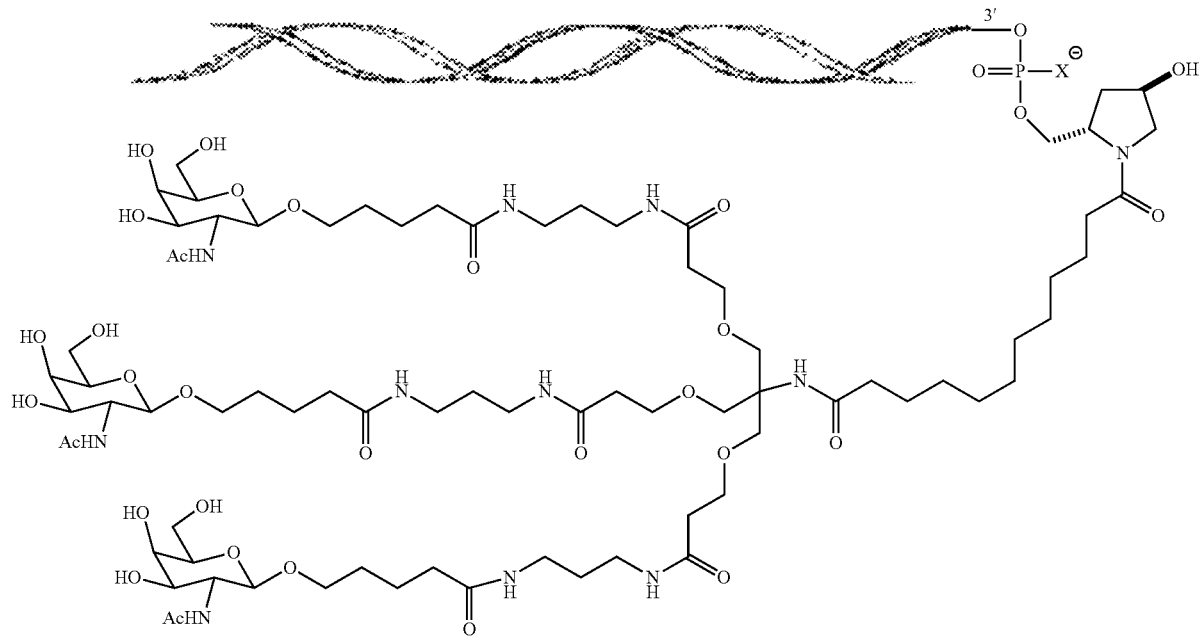

wherein X is O or S.

9. The double stranded RNAi agent of claim 1, wherein said RNAi agent is AD-70260.1.

10. A double stranded RNAi agent for inhibiting expression of hepatitis D virus (HDV) in a cell, wherein said double stranded RNAi agent comprises a sense strand and an antisense strand forming a double-stranded region, wherein said sense strand comprises the nucleotide sequence of 5'-AAGAAGAUCAAGAAACUUGAA-3' (SEQ ID NO:1963), and the antisense strand comprises the nucleotide sequence of 5'-UUCAAGUUUCUUGAUCUUCUU-3' (SEQ ID NO:2141),
wherein substantially all of the nucleotides of said sense strand and substantially all of the nucleotides of said antisense strand are modified nucleotides,
wherein said sense strand is conjugated to a ligand attached at the 3'-terminus, and
wherein the ligand is one or more GalNAc derivatives attached through a bivalent or trivalent branched linker.

11. A composition comprising two or more of the double stranded RNAi agents independently selected from the agents of claim 1 or 9.

12. A composition for inhibiting expression of hepatitis D virus (HDV) in a cell, said composition comprising
(a) a first double-stranded RNAi agent comprising a first sense strand and a first antisense strand forming a double-stranded region,
wherein substantially all of the nucleotides of said first sense strand and substantially all of the nucleotides of said first antisense strand are modified nucleotides,
wherein said first sense strand is conjugated to a ligand attached at the 3'-terminus, and
wherein the ligand is one or more GalNAc derivatives attached through a bivalent or trivalent branched linker; and (b) a second double-stranded RNAi agent comprising a second sense strand and a second antisense strand forming a double-stranded region,
wherein substantially all of the nucleotides of said second sense strand and substantially all of the nucleotides of said second antisense strand are modified nucleotides,
wherein said second sense strand is conjugated to a ligand attached at the 3'-terminus, and
wherein the ligand is one or more GalNAc derivatives attached through a bivalent or trivalent branched linker;
wherein the first sense strand comprises the nucleotide sequence of 5'-AAGAAGAUCAAGAAACUUGAA-3' (SEQ ID NO:1963), and the second sense strand comprises the nucleotide sequence of any one of the sense strands of a duplex selected from the group consisting of
AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70271.1, AD-70268.1, AD-70269.1, AD-70256.1, AD-70257.1, and AD-70275.1, and
wherein the first antisense strand comprises the nucleotide sequence of 5'-UUCAAGUUUCUUGAUCUUCUU-3' (SEQ ID NO:2141), and the second antisense strand comprises the nucleotide sequence of any one of the antisense strands of a duplex selected from the group consisting of AD-70260.1, AD-70232.1, AD-70249.1, AD-70244.1, AD-70272.1, AD-70228.1, AD-70255.1, AD-70278.1, AD-70295.1, AD-67200.1, AD-67211.1, AD-67199.1, AD-67202.1, AD-67208.1, AD-67210.1, AD-70259.1, AD-70267.1, AD-70271.1, AD-70268.1, AD-70269.1, AD-70256.1, AD-70257.1, and AD-70275.1.

13. A double stranded RNAi agent comprising a sense strand and an antisense strand, wherein the sense strand comprises the nucleotide sequence of SEQ ID NO:1963, and the antisense strand comprises the nucleotide sequence of SEQ ID NO:2141.

14. A pharmaceutical composition comprising the double stranded RNAi agent of claim 1 or 10, or the composition of claim 12.

15. A method of inhibiting Hepatitis D virus (HDV) gene expression in a cell, the method comprising:
    (a) contacting the cell with the double stranded RNAi agent of claim 1 or 10, or the composition of claim 12; and
    (b) maintaining the cell produced in step (a) for a time sufficient to obtain degradation of the mRNA transcript of an HDV gene, thereby inhibiting expression of the HDV gene in the cell.

16. A method of treating a subject having a Hepatitis D virus (HDV) infection, comprising administering to the subject a therapeutically effective amount of the double stranded RNAi agent of claim 1 or 10, or the composition of claim 12, thereby treating said subject.

17. The method of claim 16, wherein the double stranded RNAi agent is administered at a weight based dose of about 0.01 mg/kg to about 10 mg/kg or about 0.5 mg/kg to about 50 mg/kg; a weight based dose of about 10 mg/kg to about 30 mg/kg; a weight based dose of 3 mg/kg; a weight based dose of about 10 mg/kg; or a fixed dose of about 50 mg to 200 mg.

18. The method of claim 16, wherein the double stranded RNAi agent is administered subcutaneously; or intravenously.

19. The method of claim 16, further comprising administering to the subject an additional therapeutic agent.

20. The double stranded RNAi agent of claim 1, wherein the sense strand comprises 5'-asAfsgaagauCfaAfgaAfaCfuugasa-3' (SEQ ID NO: 2319) and the antisense strand comprises 5'-usUfscaaguuUfcUfugAfuCfuucusu-3' (SEQ ID NO: 2497),
    wherein a, c, g, and u are 2'-O-methyladenosine-3'-phosphate, 2'-O-methylcytidine-3'-phosphate, 2'-O-methylguanosine-3'-phosphate, and 2'-O-methyluridine-3'-phosphate, respectively; Af, Cf, Gf, and Uf are 2'-fluoroadenosine-3'-phosphate, 2'-fluorocytidine-3'-phosphate, 2'-fluoroguanosine-3'-phosphate, and 2'-fluorouridine-3'-phosphate, respectively; and s is a phorphorothioate linkage.

21. A double stranded ribonucleic acid (RNAi) agent for inhibiting expression of hepatitis D virus (HDV) in a cell, wherein said double stranded RNAi agent comprises a sense strand and an antisense strand forming a double-stranded region,
    wherein the sense strand comprises 5'-asAfsgaagauCfaAfgaAfaCfuugasa-3' (SEQ ID NO: 2319) and the antisense strand comprises 5'-usUfscaaguuUfcUfugAfuCfuucusu-3' (SEQ ID NO: 2497),
    wherein a, c, g, and u are 2'-O-methyladenosine-3'-phosphate, 2'-O-methylcytidine-3'-phosphate, 2'-O-methylguanosine-3'-phosphate, and 2'-O-methyluridine-3'-phosphate, respectively; Af, Cf, Gf, and Uf are 2'-fluoroadenosine-3'-phosphate, 2'-fluorocytidine-3'-phosphate, 2'-fluoroguanosine-3'-phosphate, and 2'-fluorouridine-3'-phosphate, respectively; and s is a phorphorothioate linkage, and
    wherein the 3' end of the sense strand is conjugated to a ligand as shown in the following schematic wherein X is O or S.

22. A pharmaceutical composition comprising the composition of claim 11.

23. A method of inhibiting Hepatitis D virus (HDV) gene expression in a cell, the method comprising:
    (a) contacting the cell with the composition of claim 11; and
    (b) maintaining the cell produced in step (a) for a time sufficient to obtain degradation of the mRNA transcript of an HDV gene, thereby inhibiting expression of the HDV gene in the cell.

24. A method of treating a subject having a Hepatitis D virus (HDV) infection, comprising administering to the subject a therapeutically effective amount of the pharmaceutical composition of claim 14, thereby treating said subject.

* * * * *